US010017765B2

(12) United States Patent
Gomez et al.

(10) Patent No.: US 10,017,765 B2
(45) Date of Patent: Jul. 10, 2018

(54) INHIBITORS OF CACNA1A/ALPHA1A SUBUNIT INTERNAL RIBOSOMAL ENTRY SITE (IRES) AND METHODS OF TREATING SPINOCEREBELLAR ATAXIA TYPE 6

(71) Applicant: THE UNIVERSITY OF CHICAGO, Chicago, IL (US)

(72) Inventors: Christopher M. Gomez, Chicago, IL (US); Xiaofei Du, Chicago, IL (US)

(73) Assignee: THE UNIVERSITY OF CHICAGO, Chicago, IL (US)

(*) Notice: Subject to any disclaimer, the term of this patent is extended or adjusted under 35 U.S.C. 154(b) by 0 days.

(21) Appl. No.: 15/024,492

(22) PCT Filed: Jul. 2, 2014

(86) PCT No.: PCT/US2014/045316
§ 371 (c)(1),
(2) Date: Mar. 24, 2016

(87) PCT Pub. No.: WO2015/047512
PCT Pub. Date: Apr. 2, 2015

(65) Prior Publication Data
US 2016/0237431 A1 Aug. 18, 2016

Related U.S. Application Data

(60) Provisional application No. 61/882,451, filed on Sep. 25, 2013.

(51) Int. Cl.
C12N 15/113 (2010.01)
A61K 31/70 (2006.01)
A61K 31/7084 (2006.01)

(52) U.S. Cl.
CPC ............ *C12N 15/113* (2013.01); *A61K 31/70* (2013.01); *A61K 31/7084* (2013.01); *C12N 15/1138* (2013.01); *C12N 2310/11* (2013.01); *C12N 2310/141* (2013.01); *C12N 2310/314* (2013.01); *C12N 2310/3233* (2013.01); *C12N 2320/30* (2013.01)

(58) Field of Classification Search
CPC .................................................... C12N 15/113
See application file for complete search history.

(56) References Cited

U.S. PATENT DOCUMENTS

| 6,573,099 | B2 * | 6/2003 | Graham | ............... | C12N 9/1051 |
|---|---|---|---|---|---|
| | | | | | 424/93.2 |
| 2004/0023277 | A1 | 2/2004 | Lee | | |
| 2005/0096284 | A1 * | 5/2005 | McSwiggen | ..... | A61K 47/48053 |
| | | | | | 514/44 R |
| 2005/0191638 | A1 * | 9/2005 | McSwiggen | ..... | C12Y 103/0102 |
| | | | | | 435/6.11 |
| 2005/0277133 | A1 * | 12/2005 | McSwiggen | ........... | A61K 48/00 |
| | | | | | 435/6.14 |
| 2006/0003322 | A1 * | 1/2006 | Bentwich | ............. | C12N 15/113 |
| | | | | | 435/6.16 |
| 2013/0225659 | A1 | 8/2013 | Bennett | | |

FOREIGN PATENT DOCUMENTS

WO    WO99/45944    * 9/1999

OTHER PUBLICATIONS

Adkins et al., MeCP2: structure and function, Biochem. Cell Biol., 89(1):1-11 (2011).
Amende et al., Gait dynamics in mouse models of Parkinson's disease and Huntington's disease, J. Neuroeng. Rehabil., 2:20 (2005).
Baird et al., Searching for IRES, RNA, 12(10):1755-85 (2006).
Baker et al., Mutations in progranulin cause tau-negative frontotemporal dementia linked to chromosome 17, Nature, 442(7105):916-9 (2006).
Barbado et al., Gene regulation by voltage-dependent calcium channels, Biochim. Biophys. Acta, 1793(6):1096-104 (2009).
Basri et al., Spectrum and prevalence of autosomal dominant spinocerebellar ataxia in Hokkaido, the northern island of Japan: a study of 113 Japanese families, J. Hum Genet., 52(10):848-55 (2007).
Bauer et al., The pathogenic mechanisms of polyglutamine diseases and current therapeutic strategies, J. Neurochem., 110(6):1737-65 (2009).
Belmeguenai et al., Intrinsic plasticity complements long-term potentiation in parallel fiber input gain control in cerebellar Purkinje cells, J. Neurosci., 30(41):13630-43 (2010).
Benn et al., Huntingtin modulates transcription, occupies gene promoters in vivo, and binds directly to DNA in a polyglutamine-dependent manner, J. Neurosci., 28(42):10720-33 (2008).
Berthet et al., Interaction of PRMT1 with BTG/TOB proteins in cell signalling: molecular analysis and functional aspects, Genes Cells, 7(1):29-39 (2002).
Bhattacharyya et al., Desensitization of mutant acetylcholine receptors in transgenic mice reduces the amplitude of neuromuscular synaptic currents, Synapse, 27(4):367-77 (1997).
Boy et al., Reversibility of symptoms in a conditional mouse model of spinocerebellar ataxia type 3, Hum. Mol. Genet., 18(22):4282-95 (2009).
Cain et al., Voltage-gated calcium channels and disease, Biofactors, 37(3):197-205 (2011).

(Continued)

Primary Examiner — Brian A Whiteman
(74) Attorney, Agent, or Firm — Marshall, Gerstein & Borun LLP

(57) ABSTRACT

The disclosure provides methods of treating polyglutamine diseases, e.g., spinocerebellar ataxia Type 6, in a subject, comprising administering to the subject an IRES inhibitor in an amount effective for treating the SCA6 in the subject. Also provided herein are the IRES inhibitors, and pharmaceutical compositions comprising the same.

13 Claims, 55 Drawing Sheets

(56) References Cited

OTHER PUBLICATIONS

Catterall, Voltage-gated calcium channels, Cold Spring Harb Perspect Biol., 3(8):a003947 (2011).

Chen et al., Altered frequency-dependent inactivation and steady-state inactivation of polyglutamine-expanded alpha1A in SCA6, Am. J. Physiol. Cell Physiol., 292(3):C1078-86 (2007).

Cimato et al., Nerve growth factor-specific regulation of protein methylation during neuronal differentiation of PC12 cells, J. Cell Biol., 138(5):1089-103 (1997).

Clark et al., Purkinje cell expression of a mutant allele of SCA1 in transgenic mice leads to disparate effects on motor behaviors, followed by a progressive cerebellar dysfunction and histological alterations, J. Neurosci., 17(19):7385-95 (1997).

Coldwell et al., The p36 isoform of BAG-1 is translated by internal ribosome entry following heat shock, Oncogene, 20(30):4095-100 (2001).

Cornelis et al., Identification and characterization of a novel cell cycle-regulated internal ribosome entry site, Mol. Cell, 5(4):597-605 (2000).

Craig et al., Molecular epidemiology of spinocerebellar ataxia type 6, Ann. Neurol., 55(5):752-5 (2004).

Cruts et al., Null mutations in progranulin cause ubiquitin-positive frontotemporal dementia linked to chromosome 17q21, Nature, 442(7105):920-4 (2006).

Daniel et al., Cellular localization of gene expression for progranulin, J. Histochem. Cytochem., 48(7):999-1009 (2000).

Du et al., KLF15 Is a transcriptional regulator of the human 17beta-hydroxysteroid dehydrogenase type 5 gene. A potential link between regulation of testosterone production and fat stores in women, J. Clin. Endocrinol. Metab., 94(7):2594-60 (2009).

Du et al., Second cistron in CACNA1A gene encodes a transcription factor mediating cerebellar development and SCA6, Cell, 154(1):118-33 (2013).

Durr, Autosomal dominant cerebellar ataxias: polyglutamine expansions and beyond, Lancet Neurol., 9(9):885-94 (2010).

Egly et al., A history of TFIIH: two decades of molecular biology on a pivotal transcription/repair factor, DNA Repai (Amst.), 10(7):714-21 (2011).

Elden et al., Ataxin-2 intermediate-length polyglutamine expansions are associated with increased risk for ALS, Nature, 466(7310):1069-75 (2010).

Empson et al., Plasma membrane Ca2+ ATPase 2 contributes to short-term synapse plasticity at the parallel fiber to Purkinje neuron synapse, J. Neurosci., 27(14):3753-8 (2007).

Fitzgerald et al., Bridging IRES elements in mRNAs to the eukaryotic translation apparatus, Biochim. Biophys. Acta, 1789(9-10):518-28 (2009).

Fletcher et al., Absence epilepsy in tottering mutant mice is associated with calcium channel defects, Cell, 87(4):607-17 (1996).

Fureman et al., Triggers of paroxysmal dyskinesia in the calcium channel mouse mutant tottering, Pharmacol. Biochem. Behav., 73(3):631-7 (2002).

Gomez et al., A transgenic mouse model of the slow-channel syndrome, Muscle Nerve, 19(1):79-87 (1996).

Gomez et al., Active calcium accumulation underlies severe weakness in a panel of mice with slow-channel syndrome, J. Neurosci., 22(15):6447-57 (2002).

Gomez et al., Slow-channel transgenic mice: a model of postsynaptic organellar degeneration at the neuromuscular junction, J. Neurosci., 17(11):4170-9 (1997).

Gomez et al., Spinocerebellar ataxia type 6: gaze-evoked and vertical nystagmus, Purkinje cell degeneration, and variable age of onset, Ann. Neurol., 42(6):933-50 (1997).

Gomez-Ospina et al., The C terminus of the L-type voltage-gated calcium channel Ca(V)1.2 encodes a transcription factor, Cell, 127(3):591-606 (2006).

Groshong et al., Calpain activation impairs neuromuscular transmission in a mouse model of the slow-channel myasthenic syndrome, J. Clin. Invest., 117(10):2903-12 (2007).

Hashimoto et al., Postnatal development and synapse elimination of climbing fiber to Purkinje cell projection in the cerebellum, Neurosci. Res., 53(3):221-8 (2005).

Hashimoto et al., Postsynaptic P/Q-type Ca2+ channel in Purkinje cell mediates synaptic competition and elimination in developing cerebellum, Proc. Natl. Acad. Sci. USA, 108(24):9987-92 (2011).

Havel et al., Nuclear accumulation of polyglutamine disease proteins and neuropathology, Mol. Brain, 2:21 (2009).

He et al., Current understanding on the pathogenesis of polyglutamine diseases, Neurosci. Bull., 26(3):247-56 (2010).

Hellen et al., Internal ribosome entry sites in eukaryotic mRNA molecules, Genes Dev., 15(13):1593-612 (2001).

Herrup et al., Cerebellar cell degeneration in the leaner mutant mouse, Neuroscience, 7(9):2185-96 (1982).

Hibino et al., Direct interaction with a nuclear protein and regulation of gene silencing by a variant of the Ca2+-channel beta 4 subunit, Proc. Natl. Acad. Sci. USA, 100(1):307-12 (2003).

Hourez et al., Aminopyridines correct early dysfunction and delay neurodegeneration in a mouse model of spinocerebellar ataxia type 1, J. Neurosci., 31(33):11795-807 (2011).

Huang et al., Systematic and integrative analysis of large gene lists using DAVID bioinformatics resources, Nat. Protoc., 4(1):44-57 (2009).

International Search Report and Written Opinion, International Application No. PCT/US14/45316, dated Jan. 21, 2015.

Ishiguro et al., The carboxy-terminal fragment of alpha(1A) calcium channel preferentially aggregates in the cytoplasm of human spinocerebellar ataxia type 6 Purkinje cells, Acta. Neuropathol., 119(4):447-64 (2010).

Ishikawa et al., Abundant expression and cytoplasmic aggregations of [alpha] 1A voltage-dependent calcium channel protein associated with neurodegeneration in spinocerebellar ataxia type 6, Hum. Mol. Genet., 8(7):1185-93 (1999).

Jayadev et al., Cambodian founder effect for spinocerebellar ataxia type 3 (Machado-Joseph disease), J. Neurol. Sci., 250(1-2):110-3 (2006).

Jen et al., Clinical spectrum of episodic ataxia type 2, Neurology, 62(1):17-22 (2004).

Jun et al., Ablation of P/Q-type Ca(2+) channel currents, altered synaptic transmission, and progressive ataxia in mice lacking the alpha(1A)-subunit, Proc. Natl. Acad. Sci. USA, 96(26):15245-50 (1999).

Kim et al., Evaluation of antigen retrieval buffer systems, J. Mol. Histol., 35(4):409-16 (2004).

King et al., The role of IRES trans-acting factors in regulating translation initiation, Biochem. Soc. Trans., 38(6):1581-6 (2010).

Klockgether, The clinical diagnosis of autosomal dominant spinocerebellar ataxias, Cerebellum, 7(2):101-5 (2008).

Klockgether, Update on degenerative ataxias, Curr. Opin. Neurol., 24(4):339-45 (2011).

Koeppen, The hereditary ataxias, J. Neuropathol. Exp. Neurol., 57(6):531-43 (1998).

Koeppen, The pathogenesis of spinocerebellar ataxia, Cerebellum, 4(1):62-73 (2005).

Koopman et al., Annexin V for flow cytometric detection of phosphatidylserine expression on B cells undergoing apoptosis, Blood, 84(5):1415-20 (1994).

Kordasiewicz et al., C-termini of P/Q-type Ca2+ channel alpha1A subunits translocate to nuclei and promote polyglutamine-mediated toxicity, Hum Mol. Genet., 15(10):1587-99 (2006).

Kordasiewicz et al., Molecular pathogenesis of spinocerebellar ataxia type 6, Neurotherapeutics, 4(2):285-94 (2007).

Kozel et al., Balance and hearing deficits in mice with a null mutation in the gene encoding plasma membrane Ca2+-ATPase isoform 2, J. Biol. Chem., 273(30):18693-6 (1998).

Kubodera et al., Proteolytic cleavage and cellular toxicity of the human alpha1A calcium channel in spinocerebellar ataxia type 6, Neurosci. Lett., 341(1):74-8 (2003).

Kurnellas et al., Role of plasma membrane calcium ATPase isoform 2 in neuronal function in the cerebellum and spinal cord, Ann. NY Acad. Sci., 1099:287-91 (2007).

Kurtzke, Epidemiology of amyotrophic lateral sclerosis, Adv. Neurol., 36:281-302 (1982).

(56) References Cited

OTHER PUBLICATIONS

La Spada et al., Androgen receptor gene mutations in X-linked spinal and bulbar muscular atrophy, Nature, 352(6330):77-9 (1991).
La Spada et al., Polyglutamines placed into context, Neuron., 38(5):681-4 (2003).
La Spada et al., Repeat expansion disease: progress and puzzles in disease pathogenesis, Nat. Rev. Genet., 11(4):247-58 (2010).
Latchman, Transcription-factor mutations and disease, N. Engl. J. Med., 334(1):28-33 (1996).
Lau et al., Expression of calcium channel alpha1A mRNA and protein in the leaner mouse (tgla/tgla) cerebellum, Brain Res. Mol. Brain Res., 59(1):93-9 (1998).
Lauring et al., Evidence that an IRES within the Notch2 coding region can direct expression of a nuclear form of the protein, Mol. Cell, 6(4):939-45 (2000).
Li et al., Cellular defects and altered gene expression in PC12 cells stably expressing mutant huntingtin, J. Neurosci., 19(13):5159-72 (1999).
Li et al., Transgenic inhibition of Nogo-66 receptor function allows axonal sprouting and improved locomotion after spinal injury, 29(1):26-39 (2005).
Li et al., ZMIZ1 preferably enhances the transcriptional activity of androgen receptor with short polyglutamine tract, PLoS One, 6(9):e25040 (2011).
Liu et al., Impact of the leaner P/Q-type Ca2+ channel mutation on excitatory synaptic transmission in cerebellar Purkinje cells, J. Physiol., 486:4501-15 (2008).
Lopez-Bastida et al., Social economic costs and health-related quality of life in patients with degenerative cerebellar ataxia in Spain, Mov. Disord., 23(2):212-7 (2008).
Lory et al., Calcium channelopathies in inherited neurological disorders: relevance to drug screening for acquired channel disorders, IDrugs, 13(7):467-71 (2010).
Marelli et al., Autosomal dominant cerebellar ataxias, Rev. Neurol. (Paris), 167(5):385-400 (2011).
Marqueze-Pouey et al., Toxicity and endocytosis of spinocerebellar ataxia type 6 polyglutamine domains: role of myosin IIb, Traffic, 9(7):1088-100 (2008).
Matsukawa et al., Motor dysfunction and altered synaptic transmission at the parallel fiber-Purkinje cell synapse in mice lacking potassium channels Kv3.1 and Kv3.3, J. Neurosci., 23(20):7677-84 (2003).
Matsushita et al., Bidirectional alterations in cerebellar synaptic transmission of tottering and rolling Ca2+ channel mutant mice, J. Neurosci., 22(11):4388-98 (2002).
Matsuyama et al., Direct alteration of the P/Q-type Ca2+ channel property by polyglutamine expansion in spinocerebellar ataxia 6, J. Neurosci., 19(12):RC14 (1999).
Matsuyama et al., Molecular features of the CAG repeats of spinocerebellar ataxia 6 (SCA6), Hum. Mol. Genet., 6(8):1283-7 (1997).
Mintz et al., Calcium control of transmitter release at a cerebellar synapse, Neuron, 15(3):675-88 (1995).
Mitchell et al., The Apaf-1 internal ribosome entry segment attains the correct structural conformation for function via interactions with PTB and unr, Mol. Cell, 11(3):757-71 (2003).
Miyazaki et al., Development of an anatomical technique for visualizing the mode of climbing fiber innervation in Purkinje cells and its application to mutant mice lacking GluR?2 and Ca(v)2.1, Anat. Sci. Int., 86(1):10-8 (2011).
Moseley et al., Incidence of dominant spinocerebellar and Friedreich triplet repeats among 361 ataxia families, Neurology, 51(6):1666-71 (1998).
NCBI Reference Sequence NM_001127222.1, *Homo sapiens* calcium channel, voltage-dependent, P/Q type, alpha 1A subunit (CACNA1A), transcript variant 4, mRNA (Jan. 2011).
Novac et al., Inhibitors of protein synthesis identified by a high throughput multiplexed translation screen, Nucleic Acids Res., 32(3):902-15 (2004).
Pathan et al., Polyglutamine-expanded ataxin-7 inhibits STAGA histone acetyltransferase activity to produce retinal degeneration, Proc. Natl. Acad. Sci. USA, 102(24):8472-7 (2005).
Palmenberg et al., Topological Organization of Picornaviral Genomes: Statistical Prediction of RNA Structural Signals, Semin. Virol., 8:231-41 (1997).
Pepke et al., Computation for ChIP-seq and RNA-seq studies, Nat. Methods, 6(11 Suppl):522-32 (2009).
Perlman, Spinocerebellar degenerations, Handb. Clin. Neurol., 100:113-40 (2011).
Piedras-Renteria et al., Increased expression of alpha 1A Ca2+ channel currents arising from expanded trinucleotide repeats in spinocerebellar ataxia type 6, J. Neurosci., 21(23):9185-93 (2001).
Pula et al., Retinal Nerve Fibre Layer and Macular Thinning in Spinocerebellar Ataxia and Cerebellar Multisystem Atrophy, Neuroophthalmology, 35(3):108-14 (2011).
Rajakulendran et al., Neuronal P/Q-type calcium channel dysfunction in inherited disorders of the CNS, Nat. Rev. Neurol., 8(2):86-96 (2012).
Restituito et al., The polyglutamine expansion in spinocerebellar ataxia type 6 causes a beta subunit-specific enhanced activation of P/Q-type calcium channels in Xenopus oocytes, J. Neurosci., 20(17):6394-403 (2000).
Riley et al., Polyglutamine neurodegenerative diseases and regulation of transcription: assembling the puzzle, Genes Dev., 20(16):2183-92 (2006).
Robertson et al., Towards the treatment of polyglutamine diseases: the modulatory role of protein context, Curr. Med. Chem., 17(27):3058-68 (2010).
Rouault et al., Sequence analysis reveals that the BTG1 antiproliferative gene is conserved throughout evolution in its coding and 3' non-coding regions, Gene, 129(2):303-6 (1993).
Roubertie et al., Benign paroxysmal tonic upgaze, benign paroxysmal torticollis, episodic ataxia and CACNA1A mutation in a family, J. Neurol., 255(10):1600-2 (2008).
Saegusa et al., Properties of human Cav2.1 channel with a spinocerebellar ataxia type 6 mutation expressed in Purkinje cells, Mol. Cell Neurosci., 34(2):261-70 (2007).
Scott et al., Evidence for a 95 kDa short form of the alpha1A subunit associated with the omega-conotoxin MVIIC receptor of the P/Q-type Ca2+ channels, J. Neurosci., 18(2):641-7 (1998).
Shakkottai et al., Early changes in cerebellar physiology accompany motor dysfunction in the polyglutamine disease spinocerebellar ataxia type 3, J. Neurosci., 31(36):13002-14 (2011).
Shao et al., Polyglutamine diseases: emerging concepts in pathogenesis and therapy, Hum. Mol. Genet., 16 Spec No. 2:R115-23 (2007).
Shoubridge et al., ARX spectrum disorders: making inroads into the molecular pathology, Hum. Mutat., 31(8):889-900 (2010).
Sidman et al., Neurological Mutants of the Mouse, Science, 150(3695):513-6 (1965).
Sillitoe et al., Whole-mount immunohistochemistry: a high-throughput screen for patterning defects in the mouse cerebellum, J. Histochem. Cytochem., 50(2):235-44 (2002).
Sopher et al., Androgen receptor YAC transgenic mice recapitulate SBMA motor neuronopathy and implicate VEGF164 in the motor neuron degeneration, Neuron, 41(5):687-99 (2004).
Spacey et al., Two novel CACNA1A gene mutations associated with episodic ataxia type 2 and interictal dystonia, Arch. Neurol., 62(2):314-6 (2005).
Spriggs et al., Re-programming of translation following cell stress allows IRES-mediated translation to predominate, Biol. Cell, 100(1):27-38 (2008).
Spriggs et al., The human insulin receptor mRNA contains a functional internal ribosome entry segment, Nucleic Acids Res., 37(17):5881-93 (2009).
Stolze et al., Typical features of cerebellar ataxic gait, J. Neurol. Neurosurg. Psychiatry, 73(3):310-2 (2002).
Stoneley et al., Cellular internal ribosome entry segments: structures, trans-acting factors and regulation of gene expression, Oncogene, 23(18):3200-7 (2004).
Su et al., A gene atlas of the mouse and human protein-encoding transcriptomes, Proc. Natl. Acad. Sci. USA, 101(16):6062-7 (2004).

(56) References Cited

OTHER PUBLICATIONS

Takahashi et al., Expression analysis of P/Q-type Ca2+ channel alpha 1A subunit mRNA in olfactory mitral cell in N-type Ca2+ channel alpha 1B subunit gene-deficient mice, Neurosci. Lett., 359(1-2):37-40 (2004).

Takahashi et al., Polyglutamine diseases: where does toxicity come from? what is toxicity? where are we going?, J. Mol. Cell Biol., 2(4):180-91 (2010).

Toru et al., Spinocerebellar ataxia type 6 mutation alters P-type calcium channel function, J. Biol. Chem., 275(15):10893-8 (2000).

Tsuji et al., Sporadic ataxias in Japan—a population-based epidemiological study, Cerebellum, 7(2):189-97 (2008).

Ul-Hussain et al., IRES-mediated translation of the carboxy-terminal domain of the horizontal cell specific connexin Cx55.5 in vivo and in vitro, BMC Mol. Biol., 9:52 (2008).

Van Damme et al., Progranulin functions as a neurotrophic factor to regulate neurite outgrowth and enhance neuronal survival, J. Cell Biol., 181(1):37-41 (2008).

Vohra et al., Activation of apoptotic pathways at muscle fiber synapses is circumscribed and reversible in a slow-channel syndrome model, Neurobiol. Dis., 23(2):462-70 (2006).

Wang et al., Robust amyloid clearance in a mouse model of Alzheimer's disease provides novel insights into the mechanism of amyloid-beta immunotherapy, J. Neurosci., 31(11):4124-36 (2011).

Wardle et al., The genetic aetiology of late-onset chronic progressive cerebellar ataxia. A population-based study, J. Neurol., 256(3):3438 (2009).

Watanabe et al., Climbing fiber synapse elimination in cerebellar Purkinje cells, Eur. J. Neurosci., 34(10):1697-710 (2011).

Watase et al., Spinocerebellar ataxia type 6 knockin mice develop a progressive neuronal dysfunction with age-dependent accumulation of mutant CaV2.1 channels, Proc. Natl. Acad. Sci. USA, 105(33):11987-92 (2008).

Weisz et al., Potassium channel blockers inhibit the triggers of attacks in the calcium channel mouse mutant tottering, J. Neurosci., 25(16):4141-5 (2005).

Wilkins et al., Protein identification and analysis tools in the ExPASy server, Methods Mol. Biol., 112:531-52 (1999).

Wilson et al., Naturally occurring dicistronic cricket paralysis virus RNA is regulated by two internal ribosome entry sites, Mol. Cell Biol., 20(14):4990-9 (2000).

Wu et al., Genetic testing in spinocerebellar ataxia in Taiwan: expansions of trinucleotide repeats in SCA8 and SCA17 are associated with typical Parkinson's disease, Clin. Genet., 65(3):209-14 (2004).

Yabe et al., SCA6 mutation analysis in a large cohort of the Japanese patients with late-onset pure cerebellar ataxia, J. Neurol. Sci., 156(1):89-95 (1998).

Yalcin, Genes and molecular mechanisms involved in the epileptogenesis of idiopathic absence epilepsies, Seizure, 21(2):79-86 (2012).

Yang et al., Nurr1 transcriptionally regulates the expression of alpha-synuclein, Neuroreport, 19(8):867-71 (2008).

Zacharias et al., Developmental expression of the four plasma membrane calcium ATPase (PMCA) genes in the mouse, Biochim. Biophys. Acta, 1428(2-3):397-405 (1999).

Zayas et al., Inositol-1,4,5-triphosphate receptors mediate activity-induced synaptic Ca2+ signals in muscle fibers and Ca2+ overload in slow-channel syndrome, Cell Calcium, 41(4):343-52 (2007).

Zhu et al., Skeletal muscle IP3R1 receptors amplify physiological and pathological synaptic calcium signals, J. Neurosci., 31(43):15269-83 (2011).

Zhuchenko et al., Autosomal dominant cerebellar ataxia (SCA6) associated with small polyglutamine expansions in the alpha 1A-voltage-dependent calcium channel, Nat. Genet., 15(1):62-9 (1997).

Zu et al., Recovery from polyglutamine-induced neurodegeneration in conditional SCA1 transgenic mice, J. Neurosci., 24(40):8853-61 (2004).

Zucker et al., Short-term synaptic plasticity, Annu. Rev. Physiol., 64:355-405 (2002).

Zuker et al., Mfold web server for nucleic acid folding and hybridization prediction, Nucleic Acids Res., 31(13):3406-15 (2003).

\* cited by examiner

FIGURE 1A
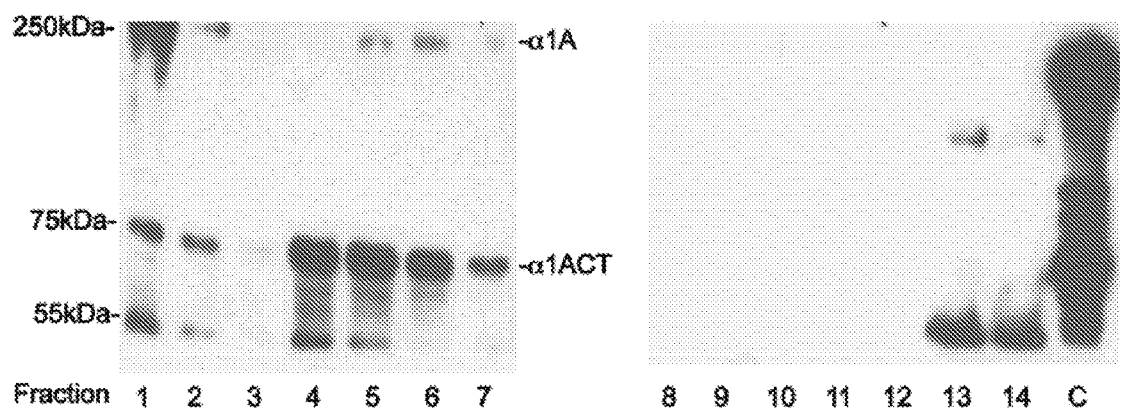
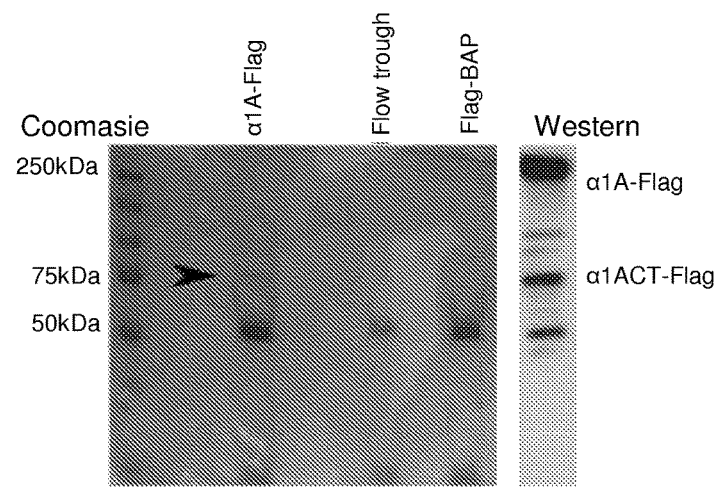
FIGURE 1B
FIGURE 1C

FIGURE 2A
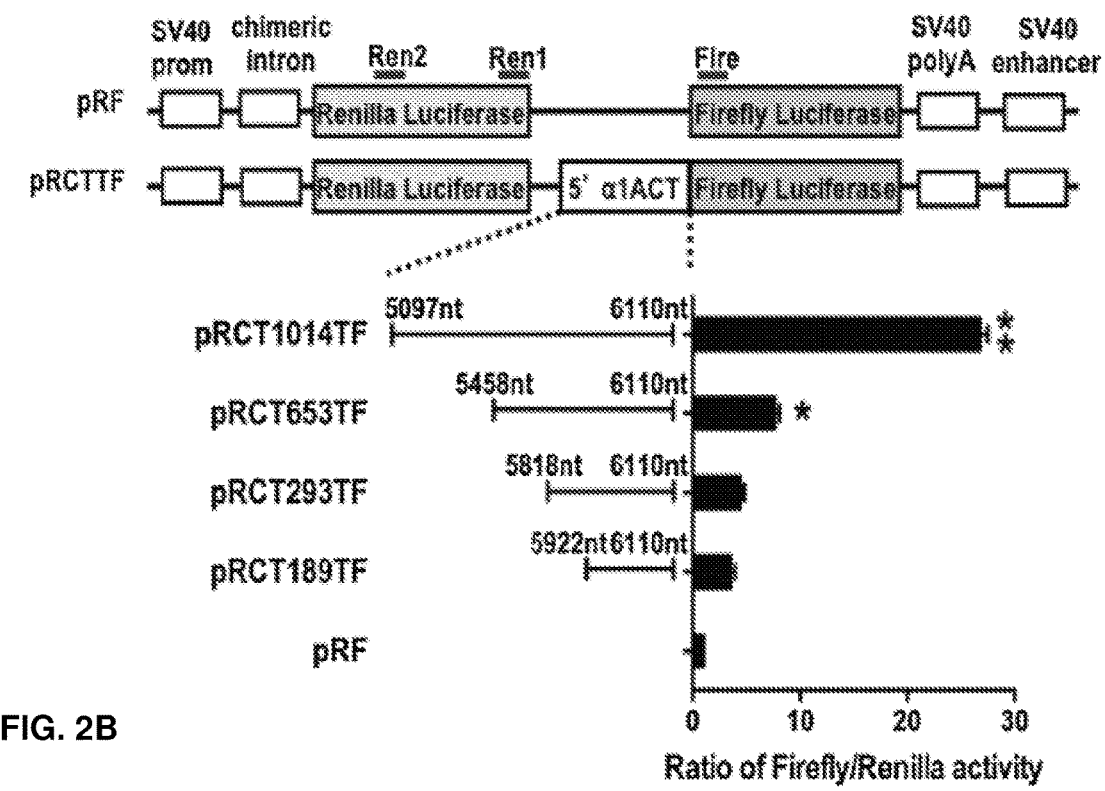
FIG. 2B
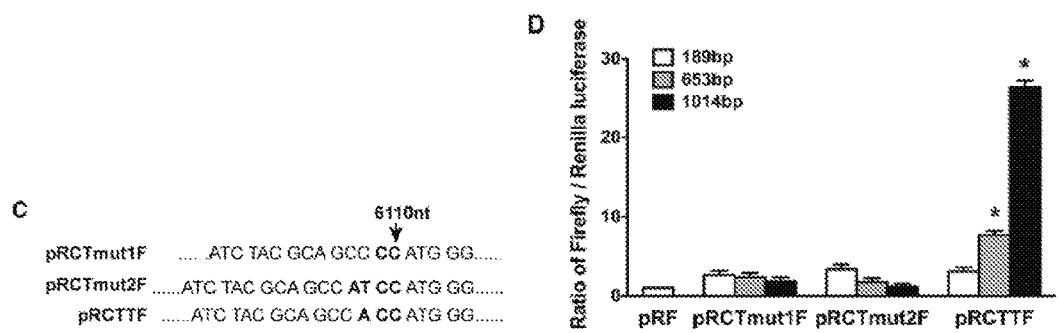
FIGURE 2C
FIGURE 2D

FIGURE 2E
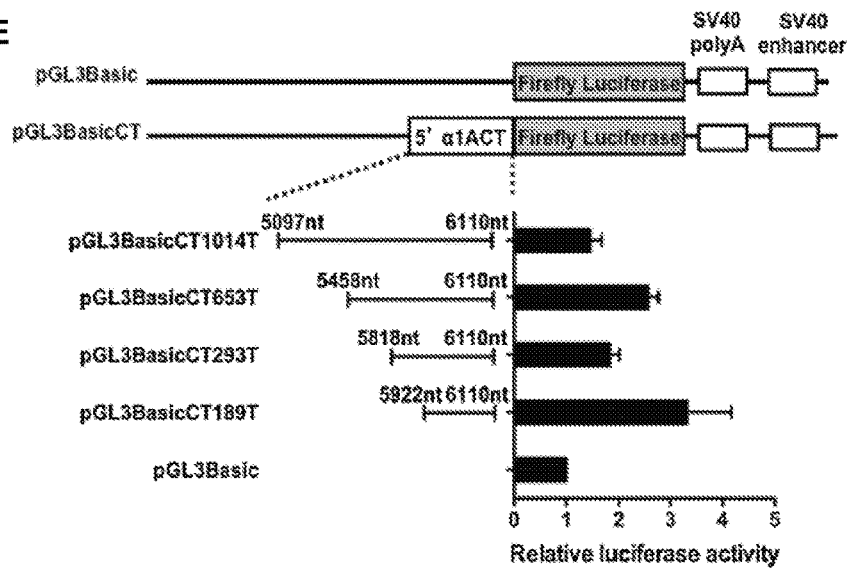
FIGURE 2F
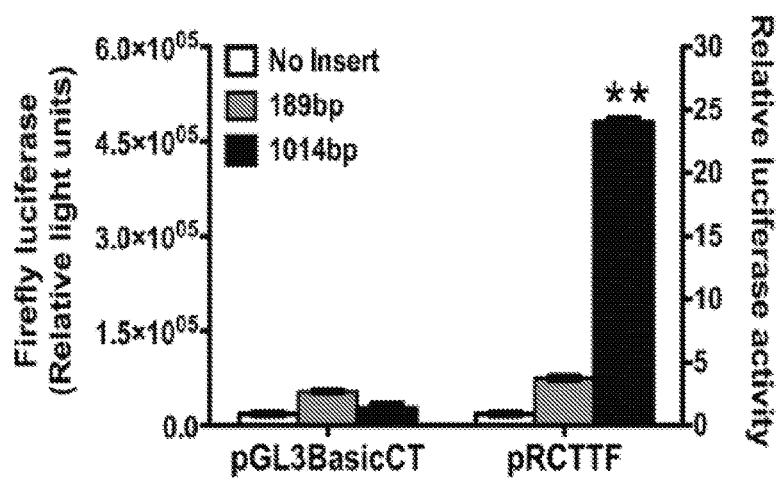
FIGURE 2G

FIGURE 4G
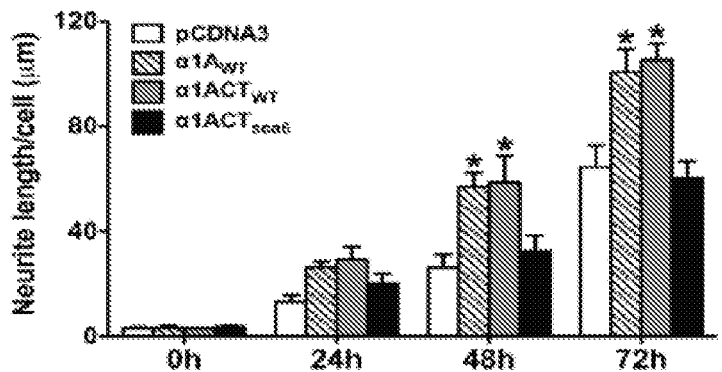
FIGURE 4H
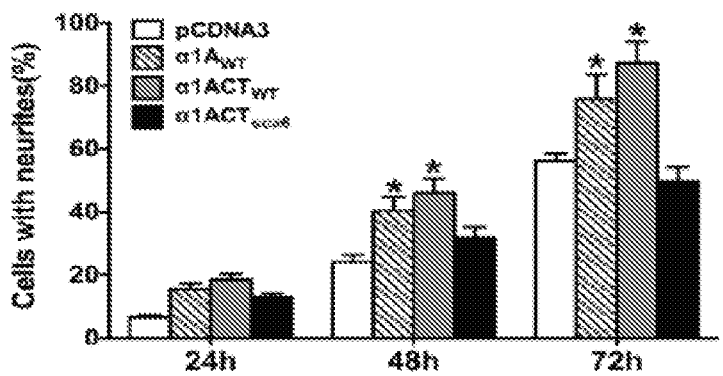
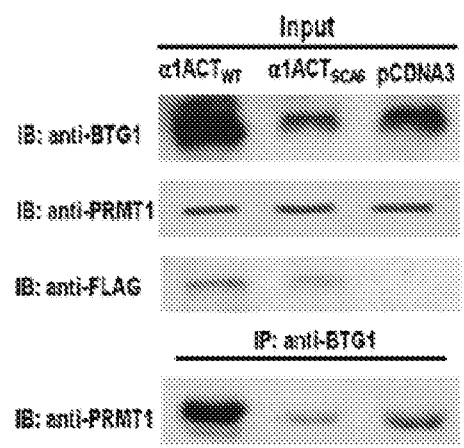
FIGURE 4I

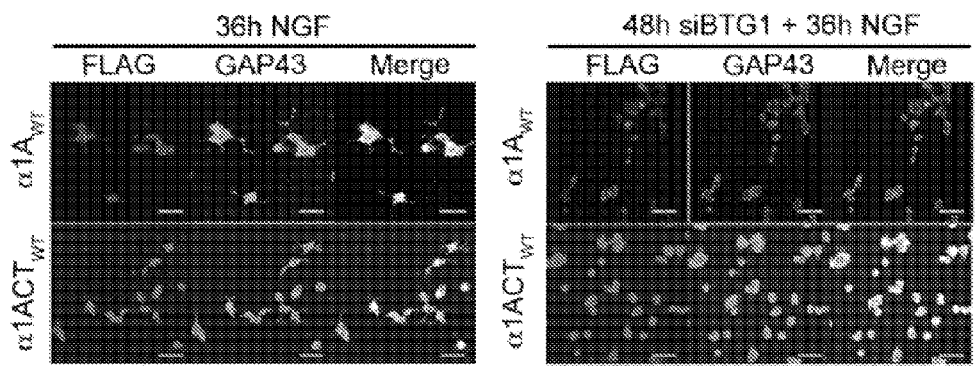
FIGURE 4J
FIGURE 4K
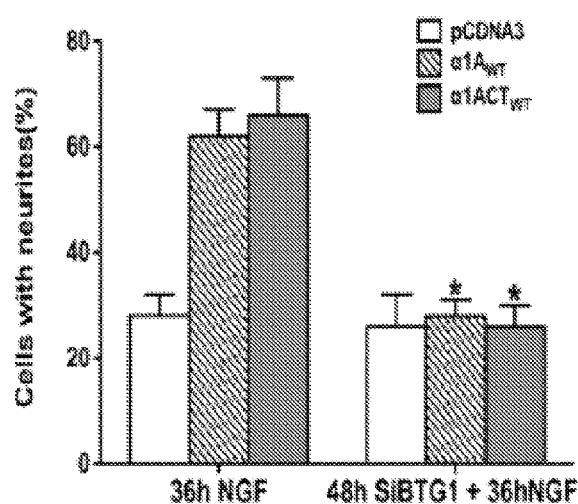
FIGURE 4L

FIGURE 5C
FIGURE 5D
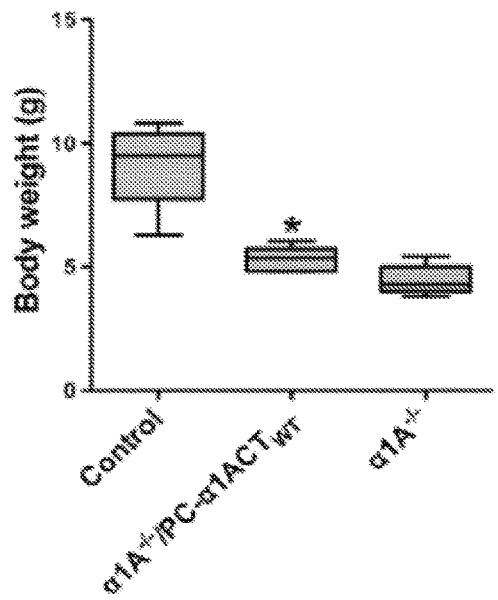
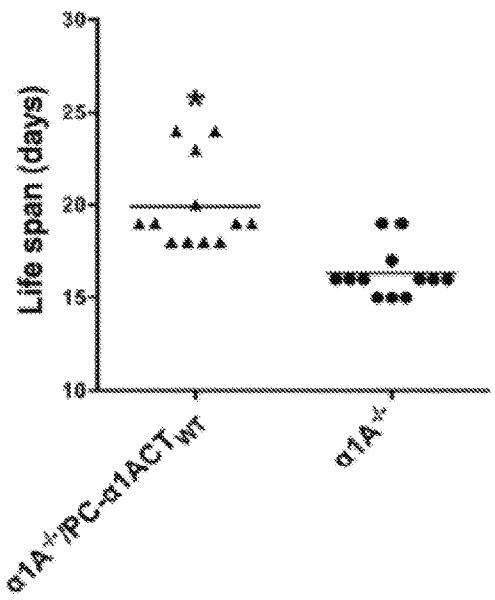
FIGURE 5E
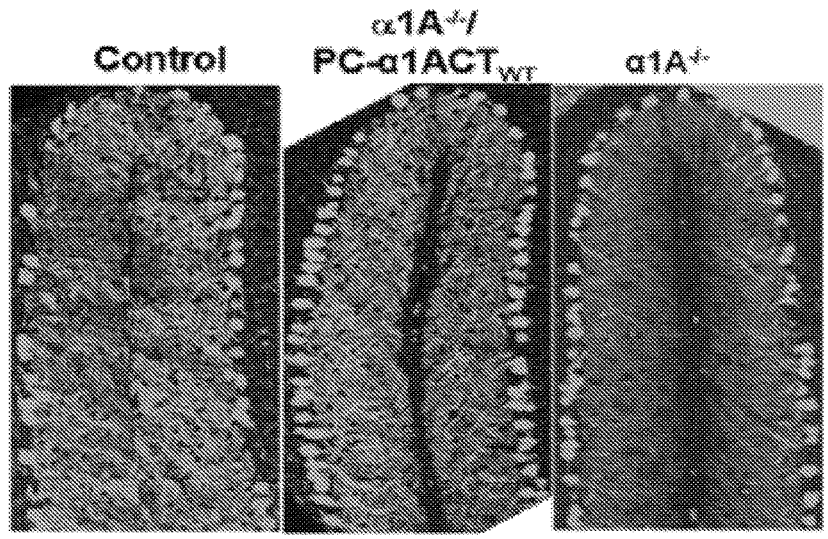

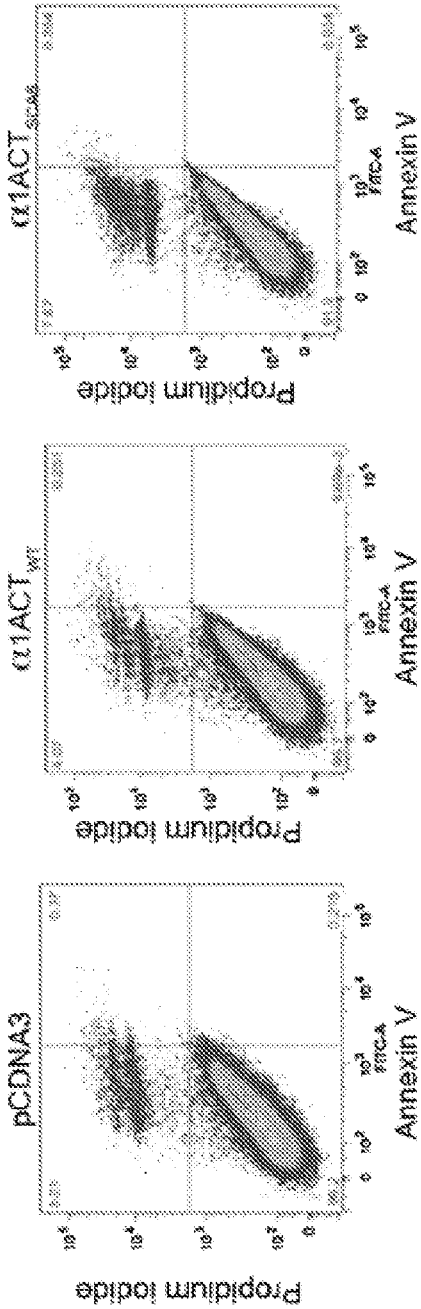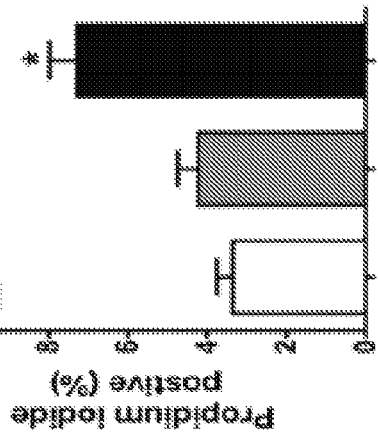
FIGURE 7A
FIGURE 7B
FIGURE 7C

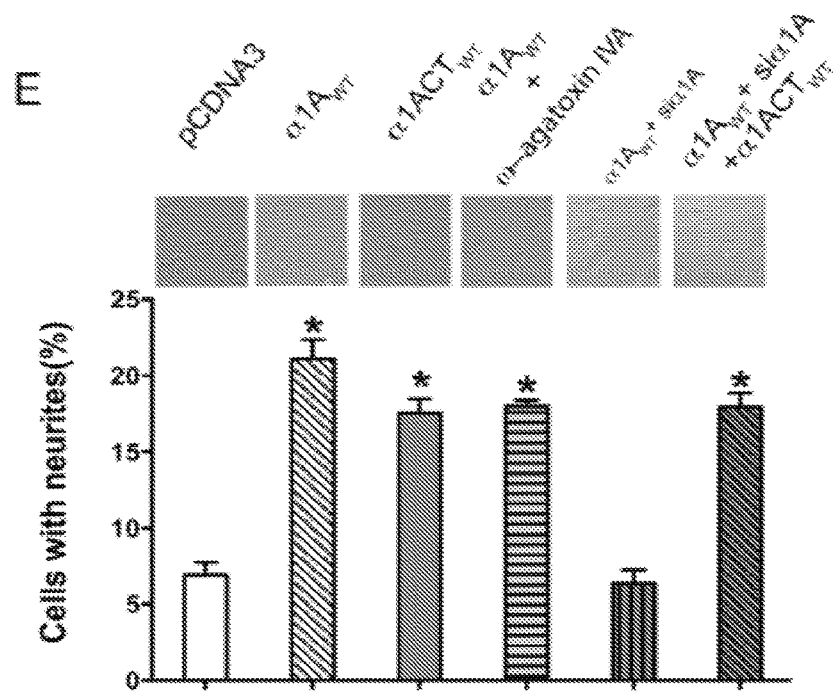
FIGURE 11E
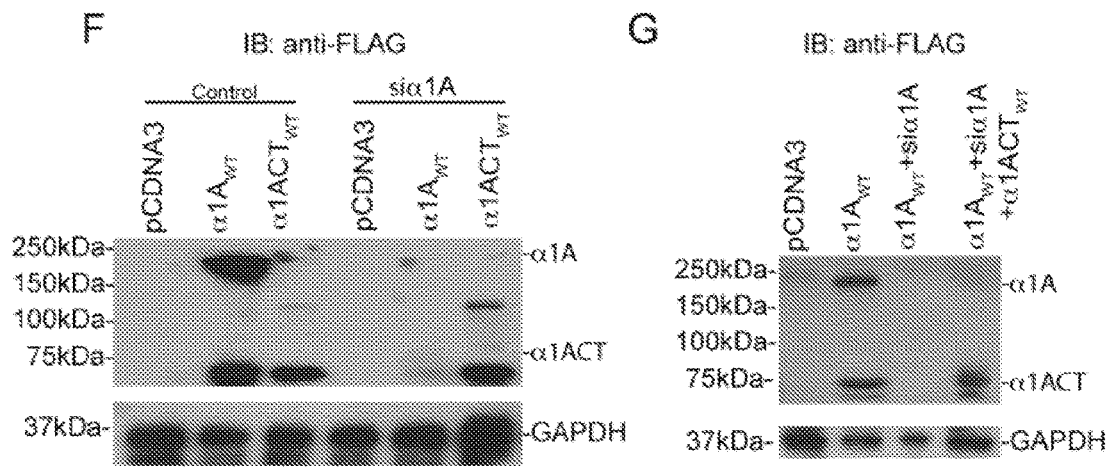
FIGURE 11F
FIGURE 11G $214^{*}(propionyl)MIMEYYR^{220}$ FIGURE 21A
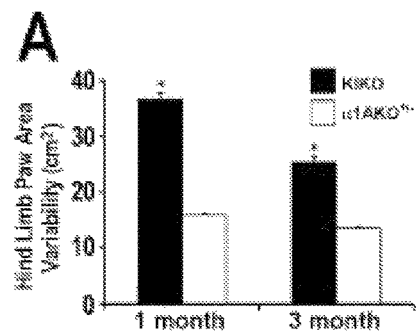
FIGURE 21B
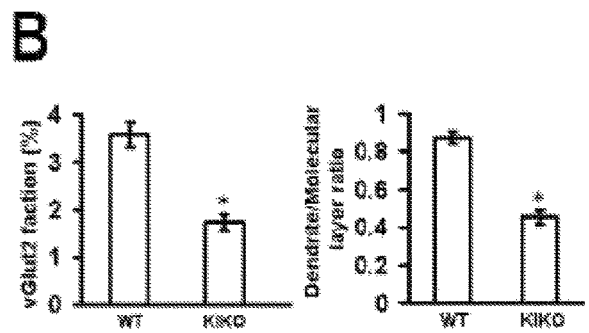
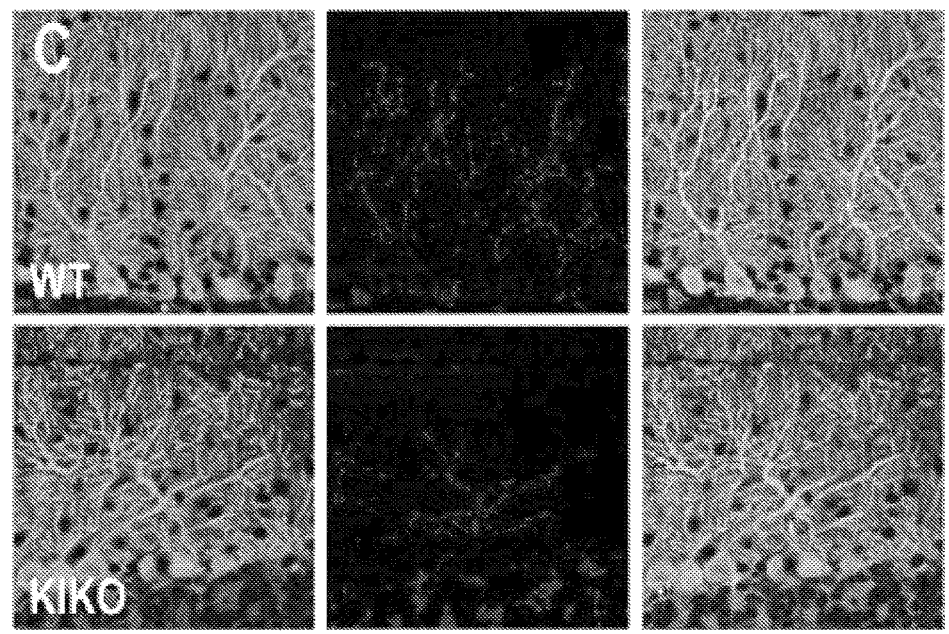
FIGURE 21C

FIGURE 25A
DEG Identification at different time point
FDR=0.05
Fold Change-1.2
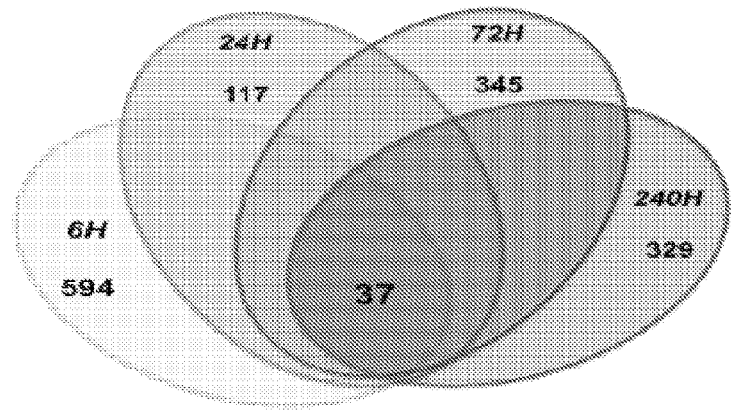
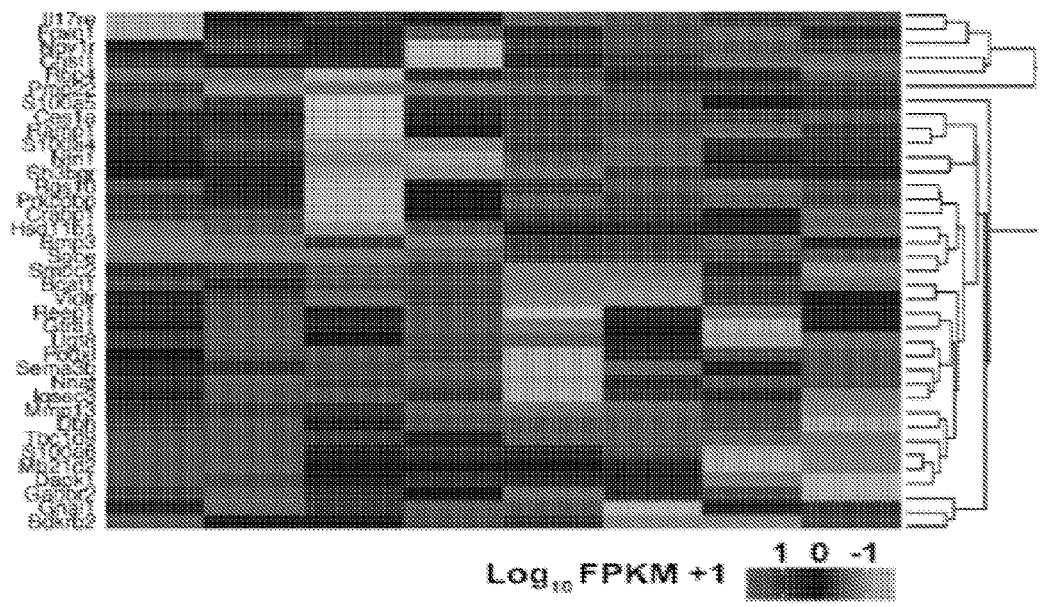
FIGURE 25B

INHIBITORS OF CACNA1A/ALPHA1A SUBUNIT INTERNAL RIBOSOMAL ENTRY SITE (IRES) AND METHODS OF TREATING SPINOCEREBELLAR ATAXIA TYPE 6

CROSS REFERENCE TO RELATED APPLICATIONS

This application is a U.S. national stage of International Application No. PCT/US2014/45316, filed on Jul. 2, 2014, which claims the priority benefit of Provisional U.S. Patent Application No. 61/882,451, filed on Sep. 25, 2013, each application of which is incorporated by reference in its entirety.

GRANT FUNDING

This invention was made with government support under Grant No. NS-062771 awarded by the National Institute of Neurological Disorders and Stroke. The government has certain rights in the invention.

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: 834,081 kilobytes ACII (Text) file named "47917A_SeqListing," created on Jul. 2, 2014.

BACKGROUND

Spinocerebellar ataxia type 6 (SCA6), a form of spinocerebellar ataxia (SCA), is a dominantly-inherited neurodegenerative disease characterized by progressive ataxia and Purkinje cell degeneration, associated with CAG repeat expansions in the gene, CACNA1A. SCA6 is a severe neurological disorder, and one of the most common SCAs worldwide (1-6), roughly as prevalent as amyotrophic lateral sclerosis (7-9).

Initially, patients with SCA6 experience problems with coordination and balance (ataxia). Other early signs and symptoms of SCA6 include speech difficulties, involuntary eye movements (nystagmus), and double vision. Over time, individuals with SCA6 may develop loss of coordination in their arms, tremors, and uncontrolled muscle tensing (dystonia). Signs and symptoms of SCA6 typically begin in a person's forties or fifties but can appear anytime from childhood to late adulthood. Most people with this disorder require wheelchair assistance by the time they are in their sixties. Patients with genetically distinct forms of SCA, including SCA6, become disabled and may progress to severe incapacitation. Many patients die prematurely due to aspiration pneumonia or respiratory failure (10-12). The advent of modern molecular genetics has enabled the confirmed molecular diagnosis and characterization of many distinct forms of SCA (13). The most reliable prevalence estimates of these heterogeneous disorders are on the order of 18-50/100,000 (9, 14). Thus, these disorders create a substantial economic and societal burden (15).

Current treatment of patients with SCA6 is focused on the treatment of manifestations. For example, acetazolamide is given to patients to eliminate episodes of ataxia, while vestibular suppressants are given to reduce vertigo and/or osscilopsia. Ophthalmology consultation is provided for refractive or surgical management of diplopia. Clonazepam is given for REM sleep disorders. Home modifications are suggested for safety and convenience. Canes, walking sticks, and walkers are prescribed in order to prevent falling. Physical therapy may also be prescribed to maximize compensation and strength, while speech therapy and communication devices are given for dysarthria. Weighted eating utensils and dressing hooks are suggested, while video esophagrams are provided to identify safest behaviors and consistency of food least likely to trigger aspiration. Feeding assessment when dysphagia becomes troublesome is considered. Furthermore, weight control, as obesity exacerbates ambulation and mobility difficulties, is provided. Moreover, CPAP may be administered to patients for sleep apnea.

However, no preventive treatment exists for the numerous polyglutamine (polyQ) diseases, including SCA6, and, currently, there are no treatments that target SCA6 itself. Thus, a method of treating SCA6, rather than a method of treating SCA6 manifestations, is needed.

SUMMARY

Presented herein are data relating to the origin and function of the α1ACT polypeptide in physiology and disease. It is demonstrated here that α1ACT is generated from the full-length α1A transcript by means of a cellular internal ribosomal entry site (IRES) located within the α1A mRNA, i.e., that the CACNA1A gene is bi-cistronic. The α1ACT protein containing the normal polyQ tract is a transcription factor that binds and enhances expression of several Purkinje cell (PC)-expressed genes, promotes neurite outgrowth, and partially rescues the CACNA1A knockout phenotype. α1ACT with expanded polyQ has altered function, reduces viability of cells in vitro, and causes gait impairment and cerebellar cortical atrophy in vivo. Herein, a truly bi-cistronic, dual-function, cellular gene encoding two proteins with completely distinct functions, in this case an ion channel and a transcription factor, is reported. This gene expression strategy demonstrates a novel role for an IRES in coordinating gene expression, as well as a potential therapeutic target for disease modifying therapy.

The disclosure provides a method of treating a genetic disease in a subject. The method comprises the step of administering to the subject an IRES inhibitor in an amount effective for treating the genetic disease. In exemplary embodiments, the genetic disease is a trinucleotide repeat disorder. In exemplary embodiments, the trinucleotide repeat disorder is a polyglutamine disease. In exemplary aspects, the polyglutamine disease is spinocerebellar ataxia Type 6 (SCA6).

Accordingly, the disclosure provides a method of treating spinocerebellar ataxia Type 6 (SCA6). The method comprises the step of administering to the subject an IRES inhibitor in an amount effective for treating the SCA6 in the subject.

The disclosure also provides a method of treating a subject with a predisposition to spinocerebellar ataxia Type 6 (SCA6). The method comprises the step of administering to the subject an IRES inhibitor in amount effective for delaying development of SCA6 in the subject.

IRES inhibitors, as well as pharmaceutical compositions comprising an IRES inhibitor, are provided herein. In exemplary embodiments, the IRES inhibitor is an antisense molecule, e.g., an antisense oligonucleotide or antisense nucleic acid analog. In exemplary aspects, the IRES inhibitor is a nucleic acid analog comprising a 6-membered morpholine ring, in place of the ribose or deoxyribose ring found in RNA or DNA. In exemplary aspects, the nucleic acid analog comprises non-ionic phosphorodiamidate inter-subunit linkages in place of anionic phosphodiester linkages found in RNA and DNA. In exemplary aspects, the nucleic acid analog comprises nucleobases (e.g., adenine, cytosine, guanine, thymine, uracil) that are found in RNA and/or DNA.

Additionally provided herein is a method of identifying a compound with SCA6 therapeutic activity. In exemplary aspects, the method comprises the steps of (i) contacting the compound with a sample comprising a nucleic acid molecule comprising at least a portion of the α1A mRNA, wherein the portion comprises at least the nucleotide sequence of the IRES of the α1A mRNA and the coding sequence of α1ACT, (ii) assaying for expression of α1ACT, wherein the compound is identified as a compound with anti-SCA6 therapeutic activity, when expression of α1ACT mRNA is reduced as compared to a control.

BRIEF DESCRIPTION OF THE DRAWINGS

FIG. 1 relates to the C terminal fragment of α1A subunit initiating at MIMEY (amino acids 1960-1964, nucleotide 6114-6128). FIG. 1A represents a Western blot analysis of fractions collected from HiTrap™ DEAE FF anion exchange chromatography. 3×FLAG-tagged α1A subunit is used as positive control. FIG. 1B represents a Coomassie blue staining of the peak α1ACT-containing fraction after two-step purification. The arrowhead indicates the 75 kD band identified by mass spectrometry as α1ACT. FIG. 1C represents a Western blot analysis of lysate from α1A over-expressing cells with anti-FLAG antibody confirms the identity of α1ACT.

FIG. 21. α1AQ14 knockin mice hemizygotes have abnormal cerebellar function and development. [A.] Treadmill (Digigait) assessment shows several abnormal gait parameters in α1AQ14/KO mice, including paw area variability compared with heterozygous KO mice (n≥3, p≤0.05.). [B.] and [C.] Innervation of Purkinje cell (green) by climbing fiber (vGlut2, red) is reduced as determined by density (left) and height (right) in α1AQ14/KO mice compared with heterozygous KO mice.

FIG. 25A is an illustration of a comparison of RNA-seq data between cells expressing α1ACT$_{WT}$ and cells expressing α1ACT$_{SCA6}$: 37 genes were found in all 4 time points, whereas a number of differentially expressed genes were found at a specific time point. FIG. 25B is a heatmap of the 37 differentially expressed genes which are at least 1.2 times differentially expressed. The average log$_{10}$FPKM values were pruned to be in [-1.1].

DETAILED DESCRIPTION

Spinocerebellar Ataxia Type 6 (SCA6)

Figure 1D:
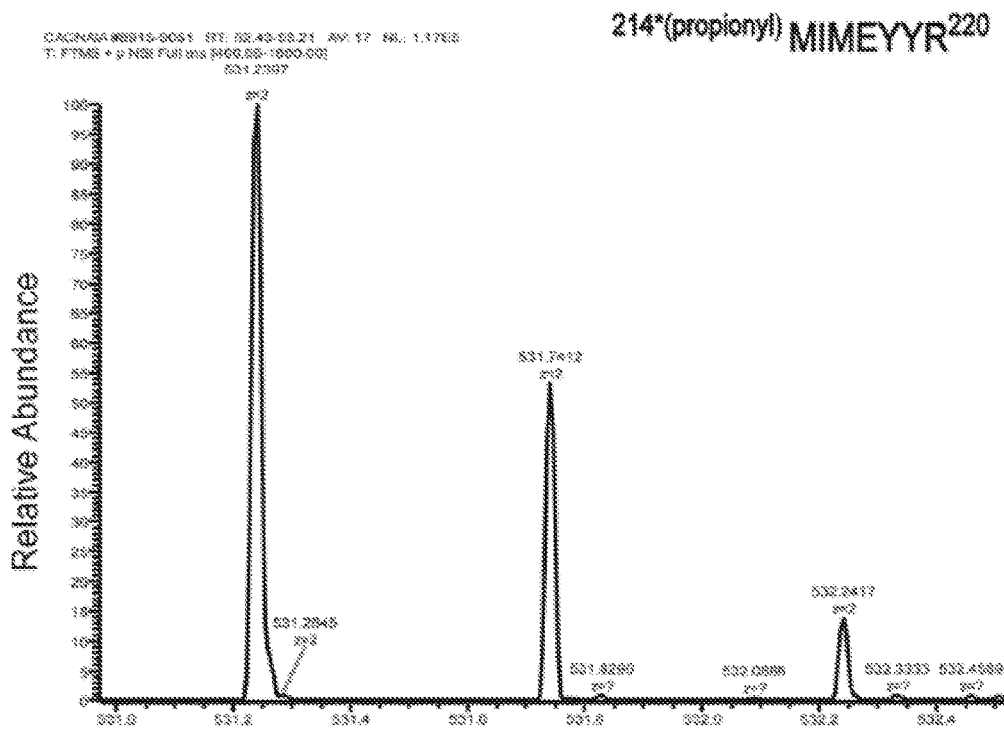
FIG. 1D represents an LC-MS/MS analysis of in-gel digest of proprionylated protein reveals that the starting amino acid sequence of N terminus of the α1ACT fragment is Met Ile Met Glu Tyr.

SCA6 is a neurodegenerative disease (polyQ disorders) caused by expansion of a polyglutamine (polyQ) tract. In SCA6, the polyQ tract expansion is encoded by the 47$^{th}$ exon of the CACNA1A gene. In exemplary aspects, the normal range of polyQ tracts is 4-18, whereas the pathological range of polyQ tracts is 19-33.

The principal gene product of CACNA1A is the α1A subunit of the P/Q-type voltage-gated Ca$^{2+}$ channel. Voltage-gated calcium channel genes encode a large family of channel proteins (α1 subunits) that play critical roles in neuronal excitability, transmitter release, muscle contractility and gene expression (Catterall, 2011). Genetic defects of these channels have been implicated in a variety of neurological, cardiac and skeletal muscle disorders (Cain and Snutch, 2011). Diverse mutations in the α1A subunit, CACNA1A gene, causing either loss or gain of P/Q-type channel function, have been associated with dominantly inherited conditions of migraine, epilepsy, and episodic and progressive ataxia (Rajakulendran et al., 2012). CACNA1A mutations of several types, leading to both loss and gain of channel function, are responsible for several types of neurological diseases, including episodic ataxia type 2, familial hemiplegic migraine, and epilepsy (27-29).

The presence of the CAG repeat encoding a polyQ tract in the C terminus of the α1A subunit led to the obvious hypothesis that the polyQ expansion in SCA6 caused a pathological disturbance of P/Q channel function (30, 31). However, several in vitro and in vivo expression studies have failed to demonstrate a consistent effect on channel function (32-36). In particular, two separate studies using CACNA1A knock-in mice with SCA6 repeat expansions failed to demonstrate any change in P/Q channel gating properties in cerebellar neurons (37, 38). Therefore, it is unlikely that SCA6 is a "channelopathy" in the classical sense. That SCA6 was attributed to expansion of polyQ tracts added further complexity to modeling both channel function and disease pathogenesis (Zhuchenko et al., 1997).

Evidence provided herein suggests that the disease is attributable to expression of a polyQ repeat expansion within a second CACNA1A gene product, α1ACT, that normally serves as a transcription factor (TF) critical for cerebellar cortical development. α1ACT is a C-terminal peptide encoded by the α1A mRNA. SCA6-sized polyQ expansions in the α1ACT TF interrupt its cellular and molecular function, and several studies have shown toxicity of α1ACT with SCA6-sized polyQ expansions in models. Several laboratories have shown that α1ACT, which contains the polyQ tract, is present as a stable fragment in cultured cells or cerebellar tissues (46-50). This fragment is enriched in cerebellar nuclei, translocated based on nuclear localization signals in the α1ACT sequence (48). Finally, several groups have shown that the α1ACT fragment bearing SCA6-expanded polyQs, unlike the full-length α1A subunit, is toxic to cultured cells or primary neurons (47-50).

As shown herein, α1ACT arises from a gene regulatory mechanism, that is novel for the CACNA1A gene and for ion channel genes in general, in which expression of α1ACT is under the control of a cryptic cellular internal ribosomal entry site (IRES) within the CACNA1A gene coding region. Based on the data herein, it is hypothesized that the cellular IRES-regulated α1ACT is required for Purkinje cell development, and that the polyQ-expanded variant, α1ACT$_{SCA6}$, leads to neurodegeneration.

Based at least in part on the data presented herein, the disclosure provides a method of treating SCA6 in a subject in need thereof. The method comprises the step of administering to the subject an IRES inhibitor in an amount effective for treating the SCA6 in the subject.

The disclosure also provides a method of treating a subject with a predisposition to spinocerebellar ataxia Type 6 (SCA6). The method comprises the step of administering to the subject an IRES inhibitor in amount effective for delaying development of SCA6 in the subject. In exemplary aspects, the subject with a predisposition to SCA6 is a subject who has a family history of SCA6. In exemplary aspects, the subject with a predisposition to SCA6 is a subject who has a parent suffering from SCA6. In exemplary aspects, the subject with a predisposition to SCA6 is a subject who has one copy of the altered CACNA1A gene having a number of polyQ tracts in the pathological range. In exemplary aspects, the subject is one who has a number of polyQ tracts in the $47^{th}$ exon of the CACNA1A gene which is considered pathological (e.g., 19 or more polyQ tracts).

In exemplary aspects, the subject is a subject who has more than 10 (e.g., more than 11, 12, 13, 14, 15, 16, 17, 18) polyQ tracts in the $47^{th}$ exon of the CACNA1A gene. In exemplary aspects, the subject is a subject who has more than 15 (e.g., 16, 17, 18) polyQ tracts in the $47^{th}$ exon of the CACNA1A gene.

Polyglutamine (PolyQ) Diseases

Because SCA6 is a polyQ disease, the steps of the method of treating SCA6 provided herein are contemplated as being useful in the treatment of other polyQ diseases. Accordingly, the disclosure provides methods of treating a polyglutamine (PolyQ) disease in a subject in need thereof. The methods comprise the step of administering to the subject an IRES inhibitor in an amount effective for treating the polyQ disease in the subject.

As used herein, the term "polyQ disease" refers to a trinucleotide repeat disorder in which the codon CAG is repeated in the coding region of a gene resulting in a polyQ tract beyond a normal or standard. PolyQ diseases known to date include those listed in the table below.

have no structural similarity otherwise. Several polyQ proteins have nuclear functions relating to gene regulation (39). Toxicity in these disorders depends on the flanking protein context of the polyQ tract, and is frequently associated with transport to the nucleus of the full length or a toxic fragment of the mutant protein (40, 41).

Neurodegenerative Diseases (ND)

Neurodegenerative diseases are defined as hereditary and sporadic conditions which are characterized by progressive nervous system dysfunction. These disorders are often associated with atrophy of the affected central or peripheral structures of the nervous system. They include diseases such as Alzheimer's Disease and other dementias, Brain Cancer, Degenerative Nerve Diseases, Encephalitis, Epilepsy, Genetic Brain Disorders, Head and Brain Malformations, Hydrocephalus, Stroke, Parkinson's Disease, Multiple Sclerosis, Amyotrophic Lateral Sclerosis (ALS or Lou Gehrig's Disease), Huntington's Disease, Prion Diseases, and others.

There are extensive overlaps between SCA and other neurodegenerative diseases (NDs) (16-19). Although neuronal cell loss is most evident in the regions responsible for the principal clinical presentation of NDs, neurodegeneration is nearly always more widespread (20-23). Moreover, there is an increasing overlap in possible disease mechanisms. For example, there are growing mechanistic genetic overlaps between ALS and SCA2 (24) and SCA6 and epilepsy (25, 26). Thus, insights into molecular pathogenesis in each disease will have a wider impact on understanding neuronal death and dysfunction in other systems.

The steps of the method of treating SCA6 provided herein are contemplated as being useful in the treatment of other neurodegenerative diseases. Accordingly, the disclosure provides methods of treating a neurodegenerative disease. The method comprises the step of administering to the subject an IRES inhibitor in an amount effective for treating the neurodegenerative disease. In exemplary aspects, the neurodegenerative disease is episodic ataxia type 2, familial hemiplegic migraine, and epilepsy, Alzheimer's Disease and other dementias, Brain Cancer, Degenerative Nerve Diseases, Encephalitis, Epilepsy, Genetic Brain Disorders, Head and Brain Malformations, Hydrocephalus, Stroke,

| PolyQ Disease | Gene | No. of PolyQ repeats in Normal State | No. of PolyQ repeats in Pathogenic State |
|---|---|---|---|
| DRPLA (Dentatorubropallidoluysian atrophy) | ATN1 or DRPLA | 6-35 | 49-88 |
| HD (Huntington's disease) | HTT (Huntingtin) | 10-35 | 35+ |
| SBMA (Spinobulbar muscular atrophy or Kennedy disease) | Androgen receptor on the X chromosome. | 9-36 | 38-62 |
| SCA1 (Spinocerebellar ataxia Type 1) | ATXN1 | 6-35 | 49-88 |
| SCA2 (Spinocerebellar ataxia Type 2) | ATXN2 | 14-32 | 33-77 |
| SCA3 (Spinocerebellar ataxia Type 3 or Machado-Joseph disease) | ATXN3 | 12-40 | 55-86 |
| SCA6 (Spinocerebellar ataxia Type 6) | CACNA1A | 4-18 | 21-30 |
| SCA7 (Spinocerebellar ataxia Type 7) | ATXN7 | 7-17 | 38-120 |
| SCA17 (Spinocerebellar ataxia Type 17) | TBP | 25-42 | 47-63 |

Source: "Trinucleotide repeat disorder" on Wickipedia, 2013

Besides being encoded by a gene comprising repeated CAG codons, the polyQ proteins involved in polyQ diseases Parkinson's Disease, Multiple Sclerosis, Amyotrophic Lateral Sclerosis (ALS or Lou Gehrig's Disease), Huntington's Disease, Prion Diseases, and others. In exemplary aspects, the neurodegenerative disease is SCA6.

IRES Inhibitors

The methods of the disclosure comprise the step of administering to a subject an IRES inhibitor. As used herein, the term "IRES" is synonymous with "internal ribosome entry site" and refers to a nucleotide sequence that allows for the initiation of translation in the middle of a messenger ribonucleic acid (mRNA) sequence as part of the greater process of protein synthesis. IRES-mediated translation in exemplary embodiments is considered as "cap-independent" translation. In exemplary aspects, the IRES is located in the 5' untranslated region (5' UTR) of a gene. In alternative aspects, the IRES is located within the middle of a mRNA.

As used herein, the term "IRES inhibitor" refers to any compound that inhibits IRES-mediated activity, e.g., IRES-mediated translation of an mRNA or IRES protein binding. In exemplary embodiments, the IRES inhibitor is a nucleic acid, a nucleic acid analog, a peptide, a polypeptide, a peptidomimetic, a peptoid, a small molecular weight compound, or the like. In exemplary aspects, the IRES inhibitor is an antisense molecule that binds to mRNA produced by a gene which gene is known to be causative of a particular disease. In exemplary aspects, the antisense molecule is an antisense oligonucleotide comprising deoxyribonucleic acid (DNA) and/or ribonucleic acid (RNA). In exemplary aspects, the antisense molecule is an antisense nucleic acid analog comprising a structural analog of DNA and/or RNA. In alternative exemplary aspects, the IRES inhibitor is a small molecular weight compound having a molecular weight of less than about 10 kDa, as measured by, for example, gel filtration chromatography. One skilled in the art will appreciate that a small molecular weight compound can be a non-peptidic compound that is cell-permeable and resistant to degradation. The term "non-peptidic" as used herein refers to not being derived from a protein. The IRES inhibitor may be natural, synthetic, or semi-synthetic or partially synthetic.

The IRES inhibitor may inhibit any one or more of IRES-mediated activities. In exemplary aspects, the IRES inhibitor inhibits IRES-mediated translation of an mRNA and/or IRES-mediated protein binding. For example, the IRES inhibitor may be a compound which blocks the binding of an IRES trans-acting factor (ITAF) to an IRES. In exemplary aspects, the IRES inhibitor binds to or adjacent to the IRES and effectively blocks the binding of the ITAF to the IRES. In alternative aspects, the IRES inhibitor binds to the ITAF and blocks the binding of the ITAF to the IRES. The IRES inhibitor may binds to the ITAF within or adjacent to the IRES-binding site of the ITAF, thereby blocking the ITAF's ability to bind to the IRES.

In additional or alternative embodiments, the IRES inhibitor blocks translation of an mRNA through additional or alternative mechanisms. In exemplary aspects, the IRES inhibitor alters the primary, secondary, and/or tertiary structure of the IRES. In exemplary aspects, the IRES inhibitor effects the change in structure of the IRES by cleaving within the IRES or modifying the chemico-physico attributes of the IRES.

The IRES inhibitor may provide any level of inhibition of IRES-mediated activity. In exemplary aspects, the IRES inhibitor inhibits at least 10% IRES-mediated activity. In exemplary aspects, the IRES inhibitor achieves at least a 50% inhibition of IRES-mediated activity. In exemplary aspects, the IRES inhibitor achieves at least a 90% inhibition of IRES-mediated activity. In exemplary aspects, the IRES inhibitor inhibits at least 10% IRES-mediated translation. In exemplary aspects, the IRES inhibitor achieves at least a 50% inhibition of IRES-mediated translation. In exemplary aspects, the IRES inhibitor achieves at least a 90% inhibition of IRES-mediated translation. Methods of testing IRES-mediated translation, and thus, methods of inhibiting IRES-mediated translation, are known in the art. See, for example, Du et al., Cell 154: 118-133 (2013) and Examples 1 and 2 herein. In exemplary aspects, methods of testing the inhibition of IRES-mediated translation comprises use of one or more bi-cistronic reporter constructs. In exemplary aspects, the IRES inhibitor inhibits at least 10% IRES-mediated protein binding, e.g., IRES-protein binding. In exemplary aspects, the IRES inhibitor achieves at least a 50% inhibition of IRES-protein binding. In exemplary aspects, the IRES inhibitor achieves at least a 90% inhibition of IRES-protein binding. Methods of testing levels of IRES-protein binding are known in the art and include for example electrophoretic mobility shift assay (EMSA). See, e.g., Ausubel, Frederick M. (1994). Current Protocols in molecular biology. Chichester: John Wiley & Sons. pp. 12.2.1-11, and Example 1 herein.

In exemplary aspects, the IRES inhibitor targets an IRES within a viral genome. In exemplary aspects, the IRES inhibitor does not target an IRES within a viral genome. IRESs found within a viral genome are known in the art and include, for example, a picornavirus IRES, aphthovirus IRES, Hepatitis A IRES, Hepatitis C IRES, Pestivirus IRES, Cripavirus IRES, Kaposi's sarcoma associated herpesvirus IRES, and the Marek's disease virus IRES. The IRES inhibitor in exemplary aspects targets an IRES within a poliovirus genome, a rhinovirus genome, an encephalomyocarditis virus genome, a foot-and-mouth disease virus genome, a Hepatitis A virus genome, a Hepatitis C virus genome, a classical swine fever virus genome, a bovine viral diarrhea virus genome, a friend murine leukemia virus genome, a Moloney murine leukemia virus genome, a Rous sarcoma virus genome, a Human immunodeficiency virus genome, a *Plautia stali* intestine virus genome, a *Rhopalosiphum padi* virus genome, a Cricket paralysis virus genome, a Triatoma virus genome, a Kaposi's sarcoma associated herpes virus genome, or a Marek's disease virus genome.

In exemplary aspects, the IRES inhibitor targets an IRES within a cellular mRNA. In exemplary aspects, the IRES inhibitor does not target an IRES within a cellular mRNA. In exemplary aspects, the cellular mRNA encodes a growth factor, a transcription factor, a translation factor, an oncogene, a transporter, a receptor, an activator of apoptosis, or a protein localized in neuronal dendrites. In exemplary aspects, the IRES inhibitor targets or does not target an mRNA encoding any one or more of the following proteins: Fibroblast growth factor (FGF-1, FGF-2), Platelet-derived growth factor B (PDGF/c-sis), Vascular endothelial growth factor (VEGF), Insulin-like growth factor 2 (IGF-II), the Antennapedia, Ultrabithorax, MYT-2, NF-κB repressing factor NRF, AML1/RUNX1, Gtx homeodomain protein, Eukaryotic initiation factor 4G (eIF4G)a, Eukaryotic initiation factor 4G1(eIF4G1)a, Death associated protein 5 (DAPS), c-myc, L-myc, Pim-1, Protein kinase p58PITSLRE, p53, Cationic amino acid transporter Cat-1, Nuclear form of Notch 2, Voltage-gated potassium channel, Apoptotic protease activating factor (Apaf-1), X-linked inhibitor of apoptosis (XIAP), HIAP2, Bcl-xL, Bcl-2, Activity-regulated cytoskeletal protein (ARC), α-subunit of calcium calmodulin dependent kinase II dendrin, Microtubule-associated protein 2 (MAP2), neurogranin (RC3), Amyloid precursor protein, Immunoglobulin heavy chain binding protein (BiP), Heat shock protein 70, (β-subunit of mitochondrial H+-ATP synthase, Ornithine decarboxylase, connexins 32 and 43, HIF-1a, APC.

In exemplary aspects, the IRES inhibitor targets the IRES of a gene associated with a diseased state. In exemplary aspects, the IRES inhibitor targets the IRES of a gene associated with a genetic disorder, e.g., a trinucleotide repeat disorder. In exemplary aspects, the IRES inhibitor targets the IRES of a gene associated with a polyglutamine disease. Genes associated with a polyQ disease are described herein. See, e.g., the table in the section entitled "Polyglutamine Diseases."

In exemplary aspects, the IRES inhibitor targets the IRES of an mRNA encoding a calcium channel or a transcription factor. In exemplary aspects, the IRES inhibitor targets the IRES of a bi-cistronic mRNA encoding both a calcium channel and a transcription factor. In exemplary aspects, the IRES inhibitor targets the IRES of the α1A mRNA, which is encoded by the CACNA1A gene. The CACNA1A gene, officially named as the calcium channel, voltage-dependent, P/Q type, alpha 1A subunit gene, is described in the Gene database of the National Center for Biotechnology Information (NCBI) as Gene ID 773. The gene encodes 5 isoforms of the α1A protein, a voltage-gated calcium channel subunit. Each are provided in the GenBank database as follows: α1A Isoform 1 (NP_000059); α1A Isoform 2 (NP_075461.2), α1A Isoform 3 (NP_001120693.1), α1A Isoform 4 (NP_001120694.1), and α1A Isoform 5 (NP_001167551.1). While the IRES is present in all five isoforms, the mRNA encoding Isoforms 1, 3, and 5 do not have the polyQ tract, whereas the mRNA encoding Isoforms 2 and 4 comprise the polyQ tract. In exemplary aspects, the IRES inhibitor targets the IRES of the mRNA of the α1A Isoform 2 or of the α1A Isoform 4. The CACNA1A gene also encodes the α1ACT protein, a transcription factor that coordinates expression of a program of genes involved in neural and Purkinje cell development. The sequence of the nucleic acid encoding the α1ACT protein is known in the art and is set forth herein as SEQ ID NO: 4.

In exemplary aspects, the IRES inhibitor blocks binding of the IRES of the α1A mRNA to an IRES ITAF which binds to the IRES of the α1A mRNA. In exemplary aspects, the IRES inhibitor binds to an ITAF that binds to the IRES of the α1A mRNA. In exemplary aspects, the IRES inhibitor binds to or adjacent to the IRES of the α1A mRNA.

In exemplary aspects, the IRES inhibitor is an antisense molecule which permits specific suppression or reduction of expression of the nucleic acid (e.g., the mRNA) encoding the α1ACT protein. In exemplary aspects, the IRES inhibitor is an antisense molecule which permits specific suppression or reduction of expression of the nucleic acid (e.g., the mRNA) encoding the α1ACT protein without affecting the expression of the nucleic acid of the α1A protein. In exemplary aspects, the IRES inhibitor causes specific suppression of translation of the nucleic acid (e.g., the mRNA) encoding the α1ACT protein without causing degradation of the α1A mRNA and/or without inhibition of expression of the α1A protein.

In exemplary aspects, the antisense molecule can be complementary to the entire coding region of the nucleic acid encoding the α1ACT protein (SEQ ID NO: 4), or to a portion thereof. The antisense molecule in exemplary aspects is about 5, about 10, about 15, about 20, about 25, about 30, about 35, about 40, about 45 or about 50 nucleotides in length.

In exemplary aspects, the antisense molecule is about X to about Y nucleotides in length, wherein X is 10, 11, 12, 13, 14, or 15 and Y is 20, 21, 22, 23, 24, 25, 26, 27, 28, 29, or 30. In exemplary aspects, the antisense molecule is about 10 to about 20 nucleotides in length, about 10 to about 21 nucleotides in length, about 10 to about 22 nucleotides in length, about 10 to about 23 nucleotides in length, about 10 to about 24 nucleotides in length, about 10 to about 25 nucleotides in length, about 10 to about 26 nucleotides in length, about 10 to about 27 nucleotides in length, about 10 to about 28 nucleotides in length, about 10 to about 29 nucleotides in length, or about 10 to about 30 nucleotides in length. In exemplary aspects, the antisense molecule is about 11 to about 20 nucleotides in length, about 11 to about 21 nucleotides in length, about 11 to about 22 nucleotides in length, about 11 to about 23 nucleotides in length, about 11 to about 24 nucleotides in length, about 11 to about 25 nucleotides in length, about 11 to about 26 nucleotides in length, about 11 to about 27 nucleotides in length, about 11 to about 28 nucleotides in length, about 11 to about 29 nucleotides in length, or about 11 to about 30 nucleotides in length. In exemplary aspects, the antisense molecule is about 12 to about 20 nucleotides in length, about 12 to about 21 nucleotides in length, about 12 to about 22 nucleotides in length, about 12 to about 23 nucleotides in length, about 12 to about 24 nucleotides in length, about 12 to about 25 nucleotides in length, about 12 to about 26 nucleotides in length, about 12 to about 27 nucleotides in length, about 12 to about 28 nucleotides in length, about 12 to about 29 nucleotides in length, or about 12 to about 30 nucleotides in length. In exemplary aspects, the antisense molecule is about 13 to about 20 nucleotides in length, about 13 to about 21 nucleotides in length, about 13 to about 22 nucleotides in length, about 13 to about 23 nucleotides in length, about 13 to about 24 nucleotides in length, about 13 to about 25 nucleotides in length, about 13 to about 26 nucleotides in length, about 13 to about 27 nucleotides in length, about 13 to about 28 nucleotides in length, about 13 to about 29 nucleotides in length, or about 13 to about 30 nucleotides in length. In exemplary aspects, the antisense molecule is about 14 to about 20 nucleotides in length, about 14 to about 21 nucleotides in length, about 14 to about 22 nucleotides in length, about 14 to about 23 nucleotides in length, about 14 to about 24 nucleotides in length, about 14 to about 25 nucleotides in length, about 14 to about 26 nucleotides in length, about 14 to about 27 nucleotides in length, about 14 to about 28 nucleotides in length, about 14 to about 29 nucleotides in length, or about 14 to about 30 nucleotides in length. In exemplary aspects, the antisense molecule is about 15 to about 20 nucleotides in length, about 15 to about 21 nucleotides in length, about 15 to about 22 nucleotides in length, about 15 to about 23 nucleotides in length, about 15 to about 24 nucleotides in length, about 15 to about 25 nucleotides in length, about 15 to about 26 nucleotides in length, about 15 to about 27 nucleotides in length, about 15 to about 28 nucleotides in length, about 15 to about 29 nucleotides in length, or about 15 to about 30 nucleotides in length. In exemplary aspects, the antisense molecule is about 15 to about 30 nucleotides in length or about 20 to 30 nucleotides in length or about 25 to 30 nucleotides in length. In exemplary aspects, the antisense molecule is about 25 nucleotides in length.

In exemplary aspects, the antisense molecule binds to at least a portion of the sequence of SEQ ID NO: 5 of the α1A mRNA. SEQ ID NO: 5 is a portion of the sequence of the nucleic acid encoding the α1ACT protein (known in the art as GenBank Accession No. NM_01127222 and provided herein as SEQ ID NO: 4. SEQ ID NO: 5 is 5101 through 6110 bp of GenBank Accession No. NM_01127222 (SEQ ID NO: 4)). In exemplary aspects, the antisense molecule binds to at least a portion of the sequence of SEQ ID NO: 5 of the α1A mRNA, wherein the portion is at least 5 contiguous nucleotides (or at least 2 or at least 3 contiguous nucleotides) of SEQ ID NO: 5. In exemplary aspects, the antisense molecule binds to at least 15 contiguous nucleotides of the sequence of SEQ ID NO: 5. In exemplary aspects, the antisense molecule binds to at least 20 contiguous nucleotides of the sequence of SEQ ID NO: 5. In exemplary aspects, the antisense molecule binds to at least 25 contiguous nucleotides of the sequence of SEQ ID NO: 5. In exemplary aspects, the antisense molecule binds to a portion of the α1A mRNA (and for purposes herein, this portion is termed hereinafter as a target sequence) and the target sequence comprises the ATG start site (i.e., start codon) of the sequence encoding α1ACT (plus flanking sequence upstream and/or downstream of the ATG start site). The coding sequence of α1ACT is provided herein as SEQ ID NO: 12 and the α1A mRNA comprising the coding sequence and the ATG start site is provided herein as SEQ ID NO: 4. In exemplary aspects, the antisense molecule binds to a target sequence of the α1A mRNA, which target sequence is located upstream or 5' to the ATG start codon of the sequence encoding α1ACT. In exemplary aspects, the antisense molecule binds to a target sequence which is located within the 200 nucleotides immediately upstream or 5' to the ATG start codon of the sequence encoding α1ACT. In exemplary aspects, the antisense molecule binds to a target sequence which is located within the 100 nucleotides immediately upstream or 5' to the ATG start codon of the sequence encoding α1ACT. In exemplary aspects, the antisense molecule binds to a target sequence which is located within the 50 nucleotides immediately upstream or 5' to the ATG start codon of the sequence encoding α1ACT. In exemplary aspects, the antisense molecule binds to a target sequence which is located within the 25 nucleotides immediately upstream or 5' to the ATG start codon of the sequence encoding α1ACT. In exemplary aspects, the antisense molecule binds to a target sequence which is located within the 15 nucleotides immediately upstream or 5' to the ATG start codon of the sequence encoding α1ACT. In exemplary aspects, the antisense molecule binds to a target sequence of the α1A mRNA, which target sequence is located downstream or 3' to the ATG start codon of the sequence encoding α1ACT. In exemplary aspects, the antisense molecule binds to a target sequence which is located within the 200 nucleotides immediately downstream or 3' to the ATG start codon of the sequence encoding α1ACT. In exemplary aspects, the antisense molecule binds to a target sequence which is located within the 100 nucleotides immediately downstream or 3' to the ATG start codon of the sequence encoding α1ACT. In exemplary aspects, the antisense molecule binds to a target sequence which is located within the 50 nucleotides immediately downstream or 3' to the ATG start codon of the sequence encoding α1ACT. In exemplary aspects, the antisense molecule binds to a target sequence which is located within the 25 nucleotides immediately downstream or 3' to the ATG start codon of the sequence encoding α1ACT. In exemplary aspects, the antisense molecule binds to a target sequence which is located within the 15 nucleotides immediately downstream or 3' to the ATG start codon of the sequence encoding α1ACT.

In exemplary aspects, the antisense molecule binds to at least a portion of the sequence of SEQ ID NO: 6 of the α1A mRNA. In exemplary aspects, the antisense molecule binds to at least a portion of the sequence of SEQ ID NO: 6 of the α1A mRNA, wherein the portion is at least 3 contiguous nucleotides (or at least 5 or at least 2 contiguous nucleotides) of SEQ ID NO: 6. In exemplary aspects, the antisense molecule binds to at least 15 contiguous nucleotides of the sequence of SEQ ID NO: 6. In exemplary aspects, the antisense molecule binds to at least 20 contiguous nucleotides of the sequence of SEQ ID NO: 6. In exemplary aspects, the antisense molecule binds to at least 25 contiguous nucleotides of the sequence of SEQ ID NO: 6. In exemplary aspects, the antisense molecule binds to at least a portion of the sequence of SEQ ID NO: 7 of the α1A mRNA. In exemplary aspects, the antisense molecule binds to at least a portion of the sequence of SEQ ID NO: 7 of the α1A mRNA, wherein the portion is at least 2 contiguous nucleotides (or at least 5 or at least 3 contiguous nucleotides) of SEQ ID NO: 7. In exemplary aspects, the antisense molecule binds to the entire sequence of SEQ ID NO: 7.

In exemplary aspects, the antisense molecule is an antisense oligonucleotide or antisense nucleic acid analog which is complementary to at least a portion of the sequence of SEQ ID NO: 5, SEQ ID NO: 6, or SEQ ID NO: 7. The antisense molecule in some aspects is complementary to at least 15 contiguous bases of said sequence. The antisense molecule in some aspects is complementary to at least 20 contiguous bases of the sequence of SEQ ID NO: 5, SEQ ID NO: 6, or SEQ ID NO: 7. The antisense molecule in some aspects is complementary to at least 25 contiguous bases of the sequence of SEQ ID NO: 5, SEQ ID NO: 6, or SEQ ID NO: 7. In exemplary aspects, the antisense molecule is an antisense oligonucleotide or antisense nucleic acid analog comprising at least 15 contiguous bases of SEQ ID NO: 9, SEQ ID NO: 10, or SEQ ID NO: 11, which are complementary sequences of SEQ ID NOs: 5-7, respectively. In exemplary aspects, the antisense molecule is an antisense oligonucleotide or antisense nucleic acid analog comprising at least 15 contiguous bases that differs by not more than 3 bases from a portion of 15 contiguous bases of SEQ ID NO: 9, SEQ ID NO: 10, or SEQ ID NO: 11. In exemplary aspects, the antisense molecule is an antisense oligonucleotide or antisense nucleic acid analog comprising at least 15 contiguous bases that is at least 90% identical to a portion of 15 contiguous bases of SEQ ID NO: 9, SEQ ID NO: 10, or SEQ ID NO: 11. In exemplary aspects, the antisense molecule is an antisense oligonucleotide or antisense nucleic acid analog comprising, consisting essentially of, or consisting of SEQ ID NO: 8.

In exemplary aspects, the antisense molecule binds to at least a portion of the sequence of SEQ ID NO: 56 of the α1A mRNA. In exemplary aspects, the antisense molecule binds to at least a portion of the sequence of SEQ ID NO: 56 of the α1A mRNA, wherein the portion is at least 2 contiguous nucleotides (or at least 5 or at least 3 contiguous nucleotides) of SEQ ID NO: 56. In exemplary aspects, the antisense molecule binds to the entire sequence of SEQ ID NO: 56. In exemplary aspects, the antisense molecule binds to at least a portion of the sequence of SEQ ID NO: 57 of the α1A mRNA. In exemplary aspects, the antisense molecule binds to at least a portion of the sequence of SEQ ID NO: 57 of the α1A mRNA, wherein the portion is at least 2 contiguous nucleotides (or at least 5 or at least 3 contiguous nucleotides) of SEQ ID NO: 57. In exemplary aspects, the antisense molecule binds to the entire sequence of SEQ ID NO: 57.

In exemplary aspects, the antisense molecule is an antisense oligonucleotide or antisense nucleic acid analog which is complementary to at least a portion of the sequence of SEQ ID NO: 56 or SEQ ID NO: 57. The antisense molecule in some aspects is complementary to at least 15 contiguous bases of said sequence. The antisense molecule in some aspects is complementary to at least 20 contiguous bases of the sequence of SEQ ID NO: 56 or SEQ ID NO: 57. The antisense molecule in some aspects is complementary to at least 25 contiguous bases of the sequence of SEQ ID NO: 56. In exemplary aspects, the antisense molecule is an antisense oligonucleotide or antisense nucleic acid analog comprising at least 15 contiguous bases of SEQ ID NO: 58 or SEQ ID NO: 59, which are complementary sequences of SEQ ID NOs: 56 and 57, respectively. In exemplary aspects, the antisense molecule is an antisense oligonucleotide or antisense nucleic acid analog comprising at least 15 contiguous bases that differs by not more than 3 bases from a portion of 15 contiguous bases of SEQ ID NO: 58 or SEQ ID NO: 59. In exemplary aspects, the antisense molecule is an antisense oligonucleotide or antisense nucleic acid analog comprising at least 15 contiguous bases that is at least 90% identical to a portion of 15 contiguous bases of SEQ ID NO: 58 or SEQ ID NO: 59. In exemplary aspects, the antisense molecule is an antisense oligonucleotide or antisense nucleic acid analog comprising, consisting essentially of, or consisting of SEQ ID NO: 55.

The antisense molecule can be one which mediates RNA interference (RNAi). As known by one of ordinary skill in the art, RNAi is a ubiquitous mechanism of gene regulation in plants and animals in which target mRNAs are degraded in a sequence-specific manner (Sharp, Genes Dev., 15, 485-490 (2001); Hutvagner et al., Curr. Opin. Genet. Dev., 12, 225-232 (2002); Fire et al., Nature, 391, 806-811 (1998); Zamore et al., Cell, 101, 25-33 (2000)). The natural RNA degradation process is initiated by the dsRNA-specific endonuclease Dicer, which promotes cleavage of long dsRNA precursors into double-stranded fragments between 21 and 25 nucleotides long, termed small interfering RNA (siRNA; also known as short interfering RNA) (Zamore, et al., Cell. 101, 25-33 (2000); Elbashir et al., Genes Dev., 15, 188-200 (2001); Hammond et al., Nature, 404, 293-296 (2000); Bernstein et al., Nature, 409, 363-366 (2001)). siRNAs are incorporated into a large protein complex that recognizes and cleaves target mRNAs (Nykanen et al., Cell, 107, 309-321 (2001). It has been reported that introduction of dsRNA into mammalian cells does not result in efficient Dicer-mediated generation of siRNA and therefore does not induce RNAi (Caplen et al., Gene 252, 95-105 (2000); Ui-Tei et al., FEBS Lett, 479, 79-82 (2000)). The requirement for Dicer in maturation of siRNAs in cells can be bypassed by introducing synthetic 21-nucleotide siRNA duplexes, which inhibit expression of transfected and endogenous genes in a variety of mammalian cells (Elbashir et al., Nature, 411: 494-498 (2001)).

In this regard, the IRES inhibitor in some aspects mediates RNAi and in some aspects is a siRNA molecule specific for inhibiting the expression of the nucleic acid (e.g., the mRNA) encoding the α1ACT protein. The term "siRNA" as used herein refers to an RNA (or RNA analog) comprising from about 10 to about 50 nucleotides (or nucleotide analogs) which is capable of directing or mediating RNAi. In exemplary embodiments, an siRNA molecule comprises about 15 to about 30 nucleotides (or nucleotide analogs) or about 20 to about 25 nucleotides (or nucleotide analogs), e.g., 21-23 nucleotides (or nucleotide analogs). The siRNA can be double or single stranded, preferably double-stranded.

In alternative aspects, the IRES inhibitor is alternatively a short hairpin RNA (shRNA) molecule specific for inhibiting the expression of the nucleic acid (e.g., the mRNA) encoding the α1ACT protein. The term "shRNA" as used herein refers to a molecule of about 20 or more base pairs in which a single-standed RNA partially contains a palindromic base sequence and forms a double-strand structure therein (i.e., a hairpin structure). An shRNA can be an siRNA (or siRNA analog) which is folded into a hairpin structure. shRNAs typically comprise about 45 to about 60 nucleotides, including the approximately 21 nucleotide antisense and sense portions of the hairpin, optional overhangs on the non-loop side of about 2 to about 6 nucleotides long, and the loop portion that can be, e.g., about 3 to 10 nucleotides long. The shRNA can be chemically synthesized. Alternatively, the shRNA can be produced by linking sense and antisense strands of a DNA sequence in reverse directions and synthesizing RNA in vitro with T7 RNA polymerase using the DNA as a template.

Though not wishing to be bound by any theory or mechanism it is believed that after shRNA is introduced into a cell, the shRNA is degraded into a length of about 20 bases or more (e.g., representatively 21, 22, 23 bases), and causes RNAi, leading to an inhibitory effect. Thus, shRNA elicits RNAi and therefore can be used as an effective component of the disclosure. shRNA may preferably have a 3'-protruding end. The length of the double-stranded portion is not particularly limited, but is preferably about 10 or more nucleotides, and more preferably about 20 or more nucleotides. Here, the 3'-protruding end may be preferably DNA, more preferably DNA of at least 2 nucleotides in length, and even more preferably DNA of 2-4 nucleotides in length.

In exemplary aspects, the antisense molecule is a microRNA (miRNA). As used herein the term "microRNA" refers to a small (e.g., 15-22 nucleotides), non-coding RNA molecule which base pairs with mRNA molecules to silence gene expression via translational repression or target degradation. microRNA and the therapeutic potential thereof are described in the art. See, e.g., Mulligan, *MicroRNA: Expression, Detection, and Therapeutic Strategies*, Nova Science Publishers, Inc., Hauppauge, N.Y., 2011; Bader and Lammers, "The Therapeutic Potential of microRNAs" *Innovations in Pharmaceutical Technology*, pages 52-55 (March 2011)

In exemplary aspects, the antisense molecule is an antisense oligonucleotide comprising DNA or RNA or both DNA and RNA. In exemplary aspects, the antisense oligonucleotide comprises naturally-occurring nucleotides and/or naturally-occurring internucleotide linkages. The antisense oligonucleotide in some aspects is single-stranded and in other aspects is double-stranded. In exemplary aspects, the antisense oligonucleotide is synthesized and in other aspects is obtained (e.g., isolated and/or purified) from natural sources. In exemplary aspects, the antisense molecule is a phosphodiester oligonucleotide.

In alternative aspects, the antisense molecule is an antisense nucleic acid analog, e.g., comprising non-naturally-occurring nucleotides and/or non-naturally-occurring internucleotide linkages (e.g., phosphoroamidate linkages, phosphorothioate linkages). In exemplary aspects, the antisense nucleic acid analog comprises one or more modified nucleotides, including, but not limited to, 5-fluorouracil, 5-bromouracil, 5-chlorouracil, 5-iodouracil, hypoxanthine, xanthine, 4-acetylcytosine, 5-(carboxyhydroxymethyl) uracil, 5-carboxymethylaminomethyl-2-thiouridine, 5-carboxymethylaminomethyluracil, dihydrouracil, beta-D-galactosylqueuo sine, inosine, $N^6$-isopentenyladenine, 1-methylguanine, 1-methylinosine, 2,2-dimethylguanine, 2-methyladenine, 2-methylguanine, 3-methylcytosine, 5-methylcytosine, N-substituted adenine, 7-methylguanine, 5-methylammomethyluracil, 5-methoxyaminomethyl-2-thiouracil, beta-D-mannosylqueuosine, 5'-methoxycarboxymethyluracil, 5-methoxyuracil, 2-methylthio-N$^6$-isopentenyladenine, uracil-5-oxyacetic acid (v), wybutoxosine, pseudouracil, queuosine, 2-thiocytosine, 5-methyl-2-thiouracil, 2-thiouracil, 4-thiouracil, 5-methyluracil, uracil-5-oxyacetic acid methylester, 3-(3-amino-3-N-2-carboxypropyl) uracil, and 2,6-diaminopurine.

In exemplary aspects, the antisense nucleic acid analog comprises non-naturally-occurring nucleotides which differ from naturally occurring nucleotides by comprising a ring structure other than ribose or 2-deoxyribose. In exemplary aspects, the antisense nucleic acid comprises non-naturally-occurring nucleotides which differ from naturally occurring nucleotides by comprising a chemical group in place of the phosphate group.

In exemplary aspects, the antisense nucleic acid analog comprises or is a methylphosphonate oligonucleotide, which are noncharged oligomers in which a non-bridging oxygen atom is replaced by a methyl group at each phosphorous in the oligonucleotide chain. In exemplary aspects, the antisense nucleic acid analog comprises or is a phosphorothioate, wherein at least one of the non-bridging oxygen atom is replaced by a sulfur at each phosphorous in the oligonucleotide chain.

In exemplary aspects, the antisense nucleic acid analog is an analog comprising a replacement of the hydrogen at the 2'-position of ribose with an O-alkyl group, e.g., methyl. In exemplary aspects, the antisense nucleic acid analog comprises a modified ribonucleotide wherein the 2' hydroxyl of ribose is modified to methoxy (OMe) or methoxy-ethyl (MOE) group. In exemplary aspects, the antisense nucleic acid analog comprises a modified ribonucleotide wherein the 2' hydroxyl of ribose is allyl, amino, azido, halo, thio, O-allyl, O—$C_1$-$C_{10}$ alkyl, O—$C_1$-$C_{10}$ substituted alkyl, O—$C_1$-$C_{10}$ alkoxy, O—$C_1$-$C_{10}$ substituted alkoxy, OCF$_3$, O(CH$_2$)$_2$SCH$_3$, O(CH$_2$)$_2$—O—N(R$^1$)(R$^2$), or O(CH$_2$)—C (=O)—N(R$^1$)(R$^2$), wherein each of R$^1$ and R$^2$ is independently selected from the group consisting of H, an amino protecting group or substituted or unsubstituted $C_1$-$C_{10}$ alkyl. In exemplary aspects, the antisense nucleic acid analog comprises a modified ribonucleotide wherein the 2' hydroxyl of ribose is 2'F, SH, CN, OCN, CF$_3$, O-alkyl, S-Alkyl, N(R$^1$)alkyl, O-alkenyl, S-alkenyl, or N(R$^1$)-alkenyl, O-alkynyl, S-alkynyl, N(R$^1$)-alkynyl, O-alkylenyl, O-Alkyl, alknyyl, alkaryl, aralkyl, O-alkaryl, or O-aralkyl.

In exemplary aspects, the antisense nucleic acid analog comprises a substituted ring. In exemplary aspects, the antisense nucleic acid analog is or comprises a hexitol nucleic acid. In exemplary aspects, the antisense nucleic acid analog is or comprises a nucleotide with a bicyclic or tricyclic sugar moiety. In exemplary aspects, the bicyclic sugar moiety comprises a bridge between the 4' and 2' furanose ring atoms. Examplary moieties include, but are not limited to: —C(R$_a$)(R$_b$)]$_n$—, —[C(R$_a$)(R$_b$)]$_n$-0-, —C(R$_a$R$_b$)—N(R)-0- or, —C(R$_a$R$_b$)-0-N(R)—; 4'-CH$_2$-2', 4'-(CH$_2$)$_2$-2', 4'-(CH$_2$)$_3$-2', 4'-(CH$_2$)-0-2' (LNA); 4'-(CH$_2$)—S-2'; 4'-(CH$_2$)$_2$-0-2' (ENA); 4'-CH(CH$_3$)-0-2' (cEt) and 4'-CH(CH$_2$OCH$_3$)-0-2', 4'-C(CH$_3$)(CH$_3$)-0-2', 4'-CH$_2$—N (OCH$_3$)-2', 4'-CH$_2$-0-N(CH$_3$)-2'4'-CH$_2$-0-N(R)-2', and 4'-CH$_2$-N(R)-0-2'-, wherein each R is, independently, H, a protecting group, or $C_1C_{12}$ alkyl; 4'-CH$_2$—N(R)-0-2', wherein R is H, C1-C12 alkyl, or a protecting group, 4'-CH$_2$—C(H)(CH$_3$)-2', 4'-CH$_2$—C(=CH$_2$)-2'. Such antisense nucleic acid analogs are known in the art. See, e.g., International Application Publication No. WO 2008/154401, U.S. Pat. No. 7,399,845, International Application Publication No. WO2009/006478, International Application Publication No. WO2008/150729, U.S. Application Publication No. US2004/0171570, U.S. Pat. No. 7,427,672, and Chattopadhyaya, et al, J. Org. Chem., 2009, 74, 118-134). In exemplary aspects, the antisense nucleic acid analog comprises a nucleoside comprising a bicyclic sugar moiety, or a bicyclic nucleoside (BNA). In exemplary aspects, the antisense nucleic acid analog comprises a BNA selected from the group consisting of: α-L-Methyleneoxy (4'-CH$_2$-0-2') BNA, Aminooxy (4'-CH$_2$-0-N(R)-2') BNA, β-D-Methyleneoxy (4'-CH$_2$-0-2') BNA, Ethyleneoxy (4'-(CH$_2$)$_2$-0-2') BNA, methylene-amino (4'-CH2-N(R)-2') BNA, methyl carbocyclic (4'-CH$_2$—CH(CH$_3$)-2') BNA, Methyl(methyleneoxy) (4'-CH(CH$_3$)-0-2') BNA (also known as constrained ethyl or cEt), methylene-thio (4'-CH$_2$—S-2') BNA, Oxyamino (4'-CH$_2$—N(R)-0-2') BNA, and propylene carbocyclic (4'-(CH$_2$)$_3$-2') BNA. Such BNAs are described in the art. See, e.g., International Patent Publication No. WO 2014/071078.

In exemplary aspects, the antisense nucleic acid analog comprises a modified backbone. In exemplary aspects, the antisense nucleic acid analog is or comprises a peptide nucleic acid (PNA) containing an uncharged flexible polyamide backbone comprising repeating N-(2-aminoethyl)glycine units to which the nucleobases are attached via methylene carbonyl linkers. In exemplary aspects, the antisense nucleic acid analog comprises a backbone substitution. In exemplary aspects, the antisense nucleic acid analog is or comprises an N3'→P5' phosphoramidate, which results from the replacement of the oxygen at the 3' position on ribose by an amine group. Such nucleic acid analogs are further described in Dias and Stein, *Molec Cancer Ther* 1: 347-355 (2002). In exemplary aspects, the antisense nucleic acid analog comprises a nucleotide comprising a conformational lock. In exemplary aspects, the antisense nucleic acid analog is or comprises a locked nucleic acid.

In exemplary aspects, the antisense nucleic acid analog comprises a 6-membered morpholine ring, in place of the ribose or 2-deoxyribose ring found in RNA or DNA. In exemplary aspects, the antisense nucleic acid analog comprises non-ionic phophorodiamidate intersubunit linkages in place of anionic phophodiester linkages found in RNA and DNA. In exemplary aspects, the nucleic acid analog comprises nucleobases (e.g., adenine (A), cytosine (C), guanine (G), thymine, thymine (T), uracil (U)) found in RNA and DNA. In exemplary aspects, the IRES inhibitor is a Morpholino oligomer comprising a polymer of subunits, each subunit of which comprises a 6-membered morpholine ring and a nucleobase (e.g., A, C, G, T, U), wherein the units are linked via non-ionic phophorodiamidate intersubunit linkages. For purposes herein, when referring to the sequence of a Morpholino oligomer, the conventional single-letter nucleobase codes (e.g., A, C, G, T, U) are used to refer to the nucleobase attached to the morpholine ring.

In exemplary aspects, the Morpholino oligomer binds to at least a portion of the sequence of SEQ ID NO: 5 of the α1A mRNA. In exemplary aspects, the Morpholino oligomer binds to at least a portion of the sequence of SEQ ID NO: 6 of the α1A mRNA. In exemplary aspects, the Morpholino oligomer binds to at least a portion of the sequence of SEQ ID NO: 7 of the α1A mRNA. In exemplary aspects, the Morpholino oligomer is complementary to at least a portion of the sequence of SEQ ID NO: 5, SEQ ID NO: 6, or SEQ ID NO: 7. The Morpholino oligomer in some aspects is complementary to at least 15 contiguous bases of said sequence. In exemplary aspects, the Morpholino oligomer comprises at least 15 contiguous bases of SEQ ID NO: 9, SEQ ID NO: 10, or SEQ ID NO: 11. In exemplary aspects, the Morpholino oligomer comprises at least 15 contiguous bases that differ by not more than 3 bases from a portion of 15 contiguous bases of SEQ ID NO: 9, SEQ ID NO: 10, or SEQ ID NO: 11. In exemplary aspects, the Morpholino oligomer comprises at least 15 contiguous bases that is at least 90% identical to a portion of 15 contiguous bases of SEQ ID NO: 9, SEQ ID NO: 10, or SEQ ID NO: 11. In exemplary aspects, the Morpholino oligomer comprises, consists essentially of, or consists of SEQ ID NO: 8.

In exemplary aspects, the Morpholino oligomer comprises the sequence of SEQ ID NO: 8. In exemplary aspects, the Morpholino oligomer comprises at least 15 contiguous bases of a sequence that (i) differs from SEQ ID NO: 8 by not more than 3 bases (e.g., not more than 4, 5, 6, 7, 8, 9, 10 bases), (ii) is at least 90% (e.g., at least 93%, at least 95%, at least 98%, at least 99%) identical to the sequence set forth in SEQ ID NO: 8, or (iii) is completely complementary to at least a portion of the sequence of SEQ ID NO: 6 or 7.

In exemplary aspects, the Morpholino oligomer binds to at least a portion of the sequence of SEQ ID NO: 56 of the α1A mRNA. In exemplary aspects, the Morpholino oligomer binds to at least a portion of the sequence of SEQ ID NO: 57 of the α1A mRNA. In exemplary aspects, the Morpholino oligomer is complementary to at least a portion of the sequence of SEQ ID NO: 56 or SEQ ID NO: 57. The Morpholino oligomer in some aspects is complementary to at least 15 contiguous bases of said sequence. In exemplary aspects, the Morpholino oligomer comprises at least 15 contiguous bases of SEQ ID NO: 58 or SEQ ID NO: 59. In exemplary aspects, the Morpholino oligomer comprises at least 15 contiguous bases that differ by not more than 3 bases from a portion of 15 contiguous bases of SEQ ID NO: 58 or SEQ ID NO: 59. In exemplary aspects, the Morpholino oligomer comprises at least 15 contiguous bases that is at least 90% identical to a portion of 15 contiguous bases of SEQ ID NO: 58 or SEQ ID NO: 59. In exemplary aspects, the Morpholino oligomer comprises, consists essentially of, or consists of SEQ ID NO: 55.

In exemplary aspects, the Morpholino oligomer comprises the sequence of SEQ ID NO: 55. In exemplary aspects, the Morpholino oligomer comprises at least 15 contiguous bases of a sequence that (i) differs from SEQ ID NO: 55 by not more than 3 bases (e.g., not more than 4, 5, 6, 7, 8, 9, 10 bases), (ii) is at least 90% (e.g., at least 93%, at least 95%, at least 98%, at least 99%) identical to the sequence set forth in SEQ ID NO: 55, or (iii) is completely complementary to at least a portion of the sequence of SEQ ID NO: 56 or 57.

Treatment

The term "treat" as well as words stemming therefrom, as used herein, do not necessarily imply 100% or complete treatment. Rather, there are varying degrees of treatment of which one of ordinary skill in the art recognizes as having a potential benefit or therapeutic effect. In this respect, the present inventive methods can provide any amount, level, or degree of treatment in a subject. Furthermore, the treatment provided by the method of the disclosure may include treatment of one or more conditions or symptoms or signs of the genetic disease, trinucleotide repeat disorder, polyQ disease, or SCA6 being treated. For example, the method of the disclosure may address one or more of: episodes of ataxia, vertigo and/or osscilopsia, diplopia, REM sleep disorders, dysarthria, dysphagia, ambulation and mobility difficulties, sleep apnea, ataxia, speech difficulties, involuntary eye movements (nystagmus), double vision, loss of coordination in their arms, tremors, uncontrolled muscle tensing (dystonia), severe incapacitation, aspiration pneumonia or respiratory failure. Also, the treatment provided by the methods of the disclosure may encompass slowing the progression of the disease or disorder. For example, the treatment may slow the progression of one or more of: episodes of ataxia, vertigo and/or osscilopsia, diplopia, REM sleep disorders, dysarthria, dysphagia, ambulation and mobility difficulties, sleep apnea, ataxia, speech difficulties, involuntary eye movements (nystagmus), double vision, loss of coordination in their arms, tremors, uncontrolled muscle tensing (dystonia), severe incapacitation, aspiration pneumonia or respiratory failure.

Subjects

As used herein, the term "subject" is meant any living organism. In exemplary aspects, the subject is a mammal. The term "mammal" as used herein refers to any mammal, including, but not limited to, mammals of the order Rodentia, such as mice and hamsters, and mammals of the order Logomorpha, such as rabbits. It is preferred that the mammals are from the order Carnivora, including Felines (cats) and Canines (dogs). It is further preferred that the mammals are from the order Artiodactyla, including Bovines (cows) and Swines (pigs) or of the order Perssodactyla, including Equines (horses). It is further preferred that the mammals are of the order Primates, Ceboids, or Simoids (monkeys) or of the order Anthropoids (humans and apes). In exemplary aspect, the subject is a human.

In exemplary embodiments, the human has, is diagnosed with, and/or suffers from a genetic disease, including, any of those known in the art and/or described herein. In exemplary aspects, the subject has, is diagnosed with, and/or suffers from a trinucleotide repeat disorder, such as a polyglutamine disease. In exemplary aspects, the human has, is diagnosed with, and/or suffers from SCA6.

Antisense Molecules and Pharmaceutical Compositions Comprising the Same

The disclosure also provides any of the aforementioned IRES inhibitors. In this regard, the disclosure provides any of the aforementioned antisense molecules, e.g., antisense oligonucleotides, antisense nucleic acid analogs, suitable for use in the inventive methods. For purposes herein, in some aspects, the IRES inhibitor, e.g., antisense molecule, is isolated, purified, or not naturally-occurring or synthetic. The term "isolated" as used herein means having been removed from its natural environment. The term "purified" as used herein means having been increased in purity, wherein "purity" is a relative term, and not to be necessarily construed as absolute purity. As used herein, the term "not naturally-occurring" refers to a molecule or compound which is not found in nature or is non-natural. An IRES inhibitor which is not naturally-occurring is "non-naturally occurring." In exemplary aspects, an IRES inhibitor which is not naturally-occurring comprises at least one component which is not found in nature. The non-natural IRES inhibitor may comprise one or more naturally-occurring components but comprises at least one component which is not found in nature. The non-naturally occurring IRES inhibitor in some aspects comprises only naturally occurring components, but the overall structure or arrangement of the components is not found in nature. It is preferred that no insertions, deletions, inversions, and/or substitutions are present in the antisense molecules of the disclosure. However, it may be suitable to comprise one or more insertions, deletions, inversions, and/or substitutions. In exemplary aspects, the antisense molecule comprises a detectable label, such as, for instance, a radioisotope, a fluorophore, or an element particle.

The antisense molecules of the disclosure can be constructed based on chemical synthesis and/or enzymatic ligation reactions using procedures known in the art. See, for example, Sambrook et al., Molecular Cloning: A Laboratory Manual, 3rd Ed., Cold Spring Harbor Press, Cold Spring Harbor, N.Y. (2001) and Ausubel et al., Current Protocols in Molecular Biology, Greene Publishing Associates and John Wiley & Sons, New York, N.Y. (1994). For example, an antisense molecule can be chemically synthesized using naturally occurring nucleotides or variously modified nucleotides designed to increase the biological stability of the molecules or to increase the physical stability of the duplex formed upon hybridization (e.g., phosphorothioate derivatives and acridine substituted nucleotides).

In exemplary aspects, the IRES inhibitor, e.g., antisense molecule, is formulated with one or more pharmaceutically acceptable carriers, diluents, and/or excipients and is provided as part of a pharmaceutical composition. In this regard, the disclosure further provides a pharmaceutical composition comprising any of the IRES inhibitors, e.g., antisense molecules, described herein. The pharmaceutical composition comprises one or more pharmaceutically acceptable carriers, diluents, and/or excipients, and is preferably sterile.

Depending on the route of administration, the particular IRES inhibitor intended for use, as well as other factors, the pharmaceutical composition may comprise additional pharmaceutically acceptable ingredients, including, for example, acidifying agents, additives, adsorbents, aerosol propellants, air displacement agents, alkalizing agents, anticaking agents, anticoagulants, antimicrobial preservatives, antioxidants, antiseptics, bases, binders, buffering agents, chelating agents, coating agents, coloring agents, desiccants, detergents, diluents, disinfectants, disintegrants, dispersing agents, dissolution enhancing agents, dyes, emollients, emulsifying agents, emulsion stabilizers, fillers, film forming agents, flavor enhancers, flavoring agents, flow enhancers, gelling agents, granulating agents, humectants, lubricants, mucoadhesives, ointment bases, ointments, oleaginous vehicles, organic bases, pastille bases, pigments, plasticizers, polishing agents, preservatives, sequestering agents, skin penetrants, solubilizing agents, solvents, stabilizing agents, suppository bases, surface IRES inhibitors, surfactants, suspending agents, sweetening agents, therapeutic agents, thickening agents, tonicity agents, toxicity agents, viscosity-increasing agents, water-absorbing agents, water-miscible cosolvents, water softeners, or wetting agents.

Accordingly, in some embodiments, the pharmaceutical composition comprises any one or a combination of the following components: acacia, acesulfame potassium, acetyltributyl citrate, acetyltriethyl citrate, agar, albumin, alcohol, dehydrated alcohol, denatured alcohol, dilute alcohol, aleuritic acid, alginic acid, aliphatic polyesters, alumina, aluminum hydroxide, aluminum stearate, amylopectin, α-amylose, ascorbic acid, ascorbyl palmitate, aspartame, bacteriostatic water for injection, bentonite, bentonite magma, benzalkonium chloride, benzethonium chloride, benzoic acid, benzyl alcohol, benzyl benzoate, bronopol, butylated hydroxyanisole, butylated hydroxytoluene, butylparaben, butylparaben sodium, calcium alginate, calcium ascorbate, calcium carbonate, calcium cyclamate, dibasic anhydrous calcium phosphate, dibasic dehydrate calcium phosphate, tribasic calcium phosphate, calcium propionate, calcium silicate, calcium sorbate, calcium stearate, calcium sulfate, calcium sulfate hemihydrate, canola oil, carbomer, carbon dioxide, carboxymethyl cellulose calcium, carboxymethyl cellulose sodium, β-carotene, carrageenan, castor oil, hydrogenated castor oil, cationic emulsifying wax, cellulose acetate, cellulose acetate phthalate, ethyl cellulose, microcrystalline cellulose, powdered cellulose, silicified microcrystalline cellulose, sodium carboxymethyl cellulose, cetostearyl alcohol, cetrimide, cetyl alcohol, chlorhexidine, chlorobutanol, chlorocresol, cholesterol, chlorhexidine acetate, chlorhexidine gluconate, chlorhexidine hydrochloride, chlorodifluoroethane (HCFC), chlorodifluoromethane, chlorofluorocarbons (CFC)chlorophenoxyethanol, chloroxylenol, corn syrup solids, anhydrous citric acid, citric acid monohydrate, cocoa butter, coloring agents, corn oil, cottonseed oil, cresol, m-cresol, o-cresol, p-cresol, croscarmellose sodium, crospovidone, cyclamic acid, cyclodextrins, dextrates, dextrin, dextrose, dextrose anhydrous, diazolidinyl urea, dibutyl phthalate, dibutyl sebacate, diethanolamine, diethyl phthalate, difluoroethane (HFC), dimethyl-β-cyclodextrin, cyclodextrin-type compounds such as Captisol®, dimethyl ether, dimethyl phthalate, dipotassium edentate, disodium edentate, disodium hydrogen phosphate, docusate calcium, docusate potassium, docusate sodium, dodecyl gallate, dodecyltrimethylammonium bromide, edentate calcium disodium, edtic acid, eglumine, ethyl alcohol, ethylcellulose, ethyl gallate, ethyl laurate, ethyl maltol, ethyl oleate, ethylparaben, ethylparaben potassium, ethylparaben sodium, ethyl vanillin, fructose, fructose liquid, fructose milled, fructose pyrogen-free, powdered fructose, fumaric acid, gelatin, glucose, liquid glucose, glyceride mixtures of saturated vegetable fatty acids, glycerin, glyceryl behenate, glyceryl monooleate, glyceryl monostearate, self-emulsifying glyceryl monostearate, glyceryl palmitostearate, glycine, glycols, glycofurol, guar gum, heptafluoropropane (HFC), hexadecyltrimethylammonium bromide, high fructose syrup, human serum albumin, hydrocarbons (HC), dilute hydrochloric acid, hydrogenated vegetable oil, type II, hydroxyethyl cellulose, 2-hydroxyethyl-β-cyclodextrin, hydroxypropyl cellulose, low-substituted hydroxypropyl cellulose, 2-hydroxypropyl-β-cyclodextrin, hydroxypropyl methylcellulose, hydroxypropyl methylcellulose phthalate, imidurea, indigo carmine, ion exchangers, iron oxides, isopropyl alcohol, isopropyl myristate, isopropyl palmitate, isotonic saline, kaolin, lactic acid, lactitol, lactose, lanolin, lanolin alcohols, anhydrous lanolin, lecithin, magnesium aluminum silicate, magnesium carbonate, normal magnesium carbonate, magnesium carbonate anhydrous, magnesium carbonate hydroxide, magnesium hydroxide, magnesium lauryl sulfate, magnesium oxide, magnesium silicate, magnesium stearate, magnesium trisilicate, magnesium trisilicate anhydrous, malic acid, malt, maltitol, maltitol solution, maltodextrin, maltol, maltose, mannitol, medium chain triglycerides, meglumine, menthol, methylcellulose, methyl methacrylate, methyl oleate, methylparaben, methylparaben potassium, methylparaben sodium, microcrystalline cellulose and carboxymethylcellulose sodium, mineral oil, light mineral oil, mineral oil and lanolin alcohols, oil, olive oil, monoethanolamine, montmorillonite, octyl gallate, oleic acid, palmitic acid, paraffin, peanut oil, petrolatum, petrolatum and lanolin alcohols, pharmaceutical glaze, phenol, liquified phenol, phenoxyethanol, phenoxypropanol, phenylethyl alcohol, phenylmercuric acetate, phenylmercuric borate, phenylmercuric nitrate, polacrilin, polacrilin potassium, poloxamer, polydextrose, polyethylene glycol, polyethylene oxide, polyacrylates, polyethylene-polyoxypropylene-block polymers, polymethacrylates, polyoxyethylene alkyl ethers, polyoxyethylene castor oil derivatives, polyoxyethylene sorbitol fatty acid esters, polyoxyethylene stearates, polyvinyl alcohol, polyvinyl pyrrolidone, potassium alginate, potassium benzoate, potassium bicarbonate, potassium bisulfite, potassium chloride, potassium citrate, potassium citrate anhydrous, potassium hydrogen phosphate, potassium metabisulfite, monobasic potassium phosphate, potassium propionate, potassium sorbate, povidone, propanol, propionic acid, propylene carbonate, propylene glycol, propylene glycol alginate, propyl gallate, propylparaben, propylparaben potassium, propylparaben sodium, protamine sulfate, rapeseed oil, Ringer's solution, saccharin, saccharin ammonium, saccharin calcium, saccharin sodium, safflower oil, saponite, serum proteins, sesame oil, colloidal silica, colloidal silicon dioxide, sodium alginate, sodium ascorbate, sodium benzoate, sodium bicarbonate, sodium bisulfite, sodium chloride, anhydrous sodium citrate, sodium citrate dehydrate, sodium chloride, sodium cyclamate, sodium edentate, sodium dodecyl sulfate, sodium lauryl sulfate, sodium metabisulfite, sodium phosphate, dibasic, sodium phosphate, monobasic, sodium phosphate, tribasic, anhydrous sodium propionate, sodium propionate, sodium sorbate, sodium starch glycolate, sodium stearyl fumarate, sodium sulfite, sorbic acid, sorbitan esters (sorbitan fatty esters), sorbitol, sorbitol solution 70%, soybean oil, spermaceti wax, starch, corn starch, potato starch, pregelatinized starch, sterilizable maize starch, stearic acid, purified stearic acid, stearyl alcohol, sucrose, sugars, compressible sugar, confectioner's sugar, sugar spheres, invert sugar, Sugartab, Sunset Yellow FCF, synthetic paraffin, talc, tartaric acid, tartrazine, tetrafluoroethane (HFC), theobroma oil, thimerosal, titanium dioxide, alpha tocopherol, tocopheryl acetate, alpha tocopheryl acid succinate, beta-tocopherol, delta-tocopherol, gamma-tocopherol, tragacanth, triacetin, tributyl citrate, triethanolamine, triethyl citrate, trimethyl-β-cyclodextrin, trimethyltetradecylammonium bromide, tris buffer, trisodium edentate, vanillin, type I hydrogenated vegetable oil, water, soft water, hard water, carbon dioxide-free water, pyrogen-free water, water for injection, sterile water for inhalation, sterile water for injection, sterile water for irrigation, waxes, anionic emulsifying wax, carnauba wax, cationic emulsifying wax, cetyl ester wax, microcrystalline wax, nonionic emulsifying wax, suppository wax, white wax, yellow wax, white petrolatum, wool fat, xanthan gum, xylitol, zein, zinc propionate, zinc salts, zinc stearate, or any excipient in the *Handbook of Pharmaceutical Excipients*, Third Edition, A. H. Kibbe (Pharmaceutical Press, London, UK, 2000), which is incorporated by reference in its entirety. *Remington's Pharmaceutical Sciences*, Sixteenth Edition, E. W. Martin (Mack Publishing Co., Easton, Pa., 1980), which is incorporated by reference in its entirety, discloses various components used in formulating pharmaceutically acceptable compositions and known techniques for the preparation thereof. Except insofar as any conventional agent is incompatible with the pharmaceutical compositions, its use in pharmaceutical compositions is contemplated. Supplementary active ingredients also can be incorporated into the compositions.

The pharmaceutical compositions may be formulated to achieve a physiologically compatible pH. In some embodiments, the pH of the pharmaceutical composition may be at least 5, at least 5.5, at least 6, at least 6.5, at least 7, at least 7.5, at least 8, at least 8.5, at least 9, at least 9.5, at least 10, or at least 10.5 up to and including pH 11, depending on the formulation and route of administration. In certain embodiments, the pharmaceutical compositions may comprise buffering agents to achieve a physiological compatible pH. The buffering agents may include any compounds capabale of buffering at the desired pH such as, for example, phosphate buffers (e.g., PBS), triethanolamine, Tris, bicine, TAPS, tricine, HEPES, TES, MOPS, PIPES, cacodylate, MES, and others.

Routes of Administration

With regard to the disclosure, the IRES inhibitor, pharmaceutical composition comprising the same, may be administered to the subject via any suitable route of administration. The following discussion on routes of administration is merely provided to illustrate exemplary embodiments and should not be construed as limiting the scope in any way.

Formulations suitable for oral administration can consist of (a) liquid solutions, such as an effective amount of the IRES inhibitor of the present disclosure dissolved in diluents, such as water, saline, or orange juice; (b) capsules, sachets, tablets, lozenges, and troches, each containing a predetermined amount of the active ingredient, as solids or granules; (c) powders; (d) suspensions in an appropriate liquid; and (e) suitable emulsions. Liquid formulations may include diluents, such as water and alcohols, for example, ethanol, benzyl alcohol, and the polyethylene alcohols, either with or without the addition of a pharmaceutically acceptable surfactant. Capsule forms can be of the ordinary hard- or soft-shelled gelatin type containing, for example, surfactants, lubricants, and inert fillers, such as lactose, sucrose, calcium phosphate, and corn starch. Tablet forms can include one or more of lactose, sucrose, mannitol, corn starch, potato starch, alginic acid, microcrystalline cellulose, acacia, gelatin, guar gum, colloidal silicon dioxide, croscarmellose sodium, talc, magnesium stearate, calcium stearate, zinc stearate, stearic acid, and other excipients, colorants, diluents, buffering agents, disintegrating agents, moistening agents, preservatives, flavoring agents, and other pharmacologically compatible excipients. Lozenge forms can comprise the IRES inhibitor of the present disclosure in a flavor, usually sucrose and acacia or tragacanth, as well as pastilles comprising the IRES inhibitor of the present disclosure in an inert base, such as gelatin and glycerin, or sucrose and acacia, emulsions, gels, and the like containing, in addition to, such excipients as are known in the art.

The IRES inhibitor s of the present disclosure, alone or in combination with other suitable components, can be delivered via pulmonary administration and can be made into aerosol formulations to be administered via inhalation. These aerosol formulations can be placed into pressurized acceptable propellants, such as dichlorodifluoromethane, propane, nitrogen, and the like. They also may be formulated as pharmaceuticals for non-pressured preparations, such as in a nebulizer or an atomizer. Such spray formulations also may be used to spray mucosa. In some embodiments, the IRES inhibitor is formulated into a powder blend or into microparticles or nanoparticles. Suitable pulmonary formulations are known in the art. See, e.g., Qian et al., Int J Pharm 366: 218-220 (2009); Adjei and Garren, Pharmaceutical Research, 7(6): 565-569 (1990); Kawashima et al., J Controlled Release 62(1-2): 279-287 (1999); Liu et al., Pharm Res 10(2): 228-232 (1993); International Patent Application Publication Nos. WO 2007/133747 and WO 2007/141411.

Formulations suitable for parenteral administration include aqueous and non-aqueous, isotonic sterile injection solutions, which can contain anti-oxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. The term, "parenteral" means not through the alimentary canal but by some other route such as subcutaneous, intramuscular, intraspinal, or intravenous. The IRES inhibitor of the present disclosure can be administered with a physiologically acceptable diluent in a pharmaceutical carrier, such as a sterile liquid or mixture of liquids, including water, saline, aqueous dextrose and related sugar solutions, an alcohol, such as ethanol or hexadecyl alcohol, a glycol, such as propylene glycol or polyethylene glycol, dimethylsulfoxide, glycerol, ketals such as 2,2-dimethyl-153-dioxolane-4-methanol, ethers, poly(ethyleneglycol) 400, oils, fatty acids, fatty acid esters or glycerides, or acetylated fatty acid glycerides with or without the addition of a pharmaceutically acceptable surfactant, such as a soap or a detergent, suspending agent, such as pectin, carbomers, methylcellulose, hydroxypropylmethylcellulose, or carboxymethylcellulose, or emulsifying agents and other pharmaceutical adjuvants.

Oils, which can be used in parenteral formulations include petroleum, animal, vegetable, or synthetic oils. Specific examples of oils include peanut, soybean, sesame, cottonseed, corn, olive, petrolatum, and mineral. Suitable fatty acids for use in parenteral formulations include oleic acid, stearic acid, and isostearic acid. Ethyl oleate and isopropyl myristate are examples of suitable fatty acid esters.

The parenteral formulations in some embodiments contain from about 0.5% to about 25% by weight of the IRES inhibitor of the present disclosure in solution. Preservatives and buffers may be used. In order to minimize or eliminate irritation at the site of injection, such compositions may contain one or more nonionic surfactants having a hydrophile-lipophile balance (HLB) of from about 12 to about 17. The quantity of surfactant in such formulations will typically range from about 5% to about 15% by weight. Suitable surfactants include polyethylene glycol sorbitan fatty acid esters, such as sorbitan monooleate and the high molecular weight adducts of ethylene oxide with a hydrophobic base, formed by the condensation of propylene oxide with propylene glycol. The parenteral formulations in some aspects are presented in unit-dose or multi-dose sealed containers, such as ampoules and vials, and can be stored in a freeze-dried (lyophilized) condition requiring only the addition of the sterile liquid excipient, for example, water, for injections, immediately prior to use. Extemporaneous injection solutions and suspensions in some aspects are prepared from sterile powders, granules, and tablets of the kind previously described.

Injectable formulations are in accordance with the disclosure. The requirements for effective pharmaceutical carriers for injectable compositions are well-known to those of ordinary skill in the art (see, e.g., *Pharmaceutics and Pharmacy Practice*, J. B. Lippincott Company, Philadelphia, Pa., Banker and Chalmers, eds., pages 238-250 (1982), and *ASHP Handbook on Injectable Drugs*, Toissel, 4th ed., pages 622-630 (1986)).

Additionally, the IRES inhibitors of the disclosure can be made into suppositories for rectal administration by mixing with a variety of bases, such as emulsifying bases or water-soluble bases. Formulations suitable for vaginal administration can be presented as pessaries, tampons, creams, gels, pastes, foams, or spray formulas containing, in addition to the active ingredient, such carriers as are known in the art to be appropriate.

It will be appreciated by one of skill in the art that, in addition to the above-described pharmaceutical compositions, the IRES inhibitor of the disclosure can be formulated as inclusion complexes, such as cyclodextrin inclusion complexes, or liposomes.

In exemplary aspects, wherein the IRES inhibitor is an antisense molecule, the antisense molecule may be formulated into a viral vector or a nonviral vector, either of which are suitable for delivery into humans. Li et al., *Cancer Gene Ther* 8:555-565 (2001) describes methods of targeted gene therapy by non viral vectors. Chen et al., *Mol Ther* describes gene therapy with a lentiviral gene delivery construct. Zhou et al., *J Healthc Eng* 4(2): 223-254 (2013) and Chen et al., *Cardiovasc Ultrasound* 11:11 (2013) describes gene deliver with ultrasound. See, e.g., Chistiakov et al., *Drug Deliv* 19(8): 392-405 (2012) and Juliano et al., *J Drug Target* 21(1): 27-43 (2013) and Southwell et al., *Trends Mol Med* 18(11): 634-643 (2012) and International Patent Application Publication Nos. WO2005/072703, WO1994/023699; WO2010/085665, and WO1998/018811.

Dosages

For purposes herein, the amount or dose of the IRES inhibitor administered should be sufficient to effect, e.g., a therapeutic or prophylactic response, in the subject or animal over a reasonable time frame. For example, the dose of the IRES inhibitor of the present disclosure should be sufficient to treat SCA6 as described herein in a period of from about 1 to 4 minutes, 1 to 4 hours or 1 to 4 weeks or longer, e.g., 5 to 20 or more weeks, from the time of administration. In certain embodiments, the time period could be even longer. The dose will be determined by the efficacy of the particular IRES inhibitor and the condition of the animal (e.g., human), as well as the body weight of the animal (e.g., human) to be treated.

Many assays for determining an administered dose are known in the art. For purposes herein, an assay, which comprises comparing the extent to which SCA6 is treated upon administration of a given dose of the IRES inhibitor of the present disclosure to a mammal among a set of mammals, each set of which is given a different dose of the IRES inhibitor, could be used to determine a starting dose to be administered to a mammal. The extent to which SCA6 is treated upon administration of a certain dose can be represented by, for example, the extent to which the expression of $\alpha 1ACT$ is reduced. Methods of measuring protein expression are known in the art, including, for instance, the methods described in the EXAMPLES set forth below.

The dose of the IRES inhibitor of the present disclosure also will be determined by the existence, nature and extent of any adverse side effects that might accompany the administration of a particular IRES inhibitor of the present disclosure. Typically, the attending physician will decide the dosage of the IRES inhibitor of the present disclosure with which to treat each individual patient, taking into consideration a variety of factors, such as age, body weight, general health, diet, sex, IRES inhibitor of the present disclosure to be administered, route of administration, and the severity of the condition being treated. By way of example and not intending to limit the scope of the claimed subject matter, the dose of the IRES inhibitor of the present disclosure can be about 0.0001 to about 1 g/kg body weight of the subject being treated/day, from about 0.0001 to about 0.001 g/kg body weight/day, or about 0.01 mg to about 1 g/kg body weight/day.

Controlled Release Formulations

In some embodiments, the IRES inhibitors described herein can be modified into a depot form, such that the manner in which the IRES inhibitor is released into the body to which it is administered is controlled with respect to time and location within the body (see, for example, U.S. Pat. No. 4,450,150). Depot forms of IRES inhibitors of the disclosure can be, for example, an implantable composition comprising the IRES inhibitors and a porous or non-porous material, such as a polymer, wherein the IRES inhibitor is encapsulated by or diffused throughout the material and/or degradation of the non-porous material. The depot is then implanted into the desired location within the body of the subject and the IRES inhibitor is released from the implant at a predetermined rate.

The pharmaceutical composition comprising the IRES inhibitor in certain aspects is modified to have any type of in vivo release profile. In some aspects, the pharmaceutical composition is an immediate release, controlled release, sustained release, extended release, delayed release, or biphasic release formulation. Methods of formulating small molecular weight compounds, peptides, and oligonucleotides or nucleic acid analogs, for controlled release are known in the art. See, for example, Qian et al., *J Pharm* 374: 46-52 (2009) and International Patent Application Publication Nos. WO 2008/130158, WO2004/033036; WO2000/032218; and WO 1999/040942.

The instant compositions may further comprise, for example, micelles or liposomes, or some other encapsulated form, or may be administered in an extended release form to provide a prolonged storage and/or delivery effect.

Timing of Administration

The disclosed pharmaceutical compositions and formulations may be administered according to any regimen including, for example, daily (1 time per day, 2 times per day, 3 times per day, 4 times per day, 5 times per day, 6 times per day), every two days, every three days, every four days, every five days, every six days, weekly, bi-weekly, every three weeks, monthly, or bi-monthly. Timing, like dosing can be fine-tuned based on dose-response studies, efficacy, and toxicity data, and initially gauged based on timing used for other antibody therapeutics.

Combinations

In some embodiments, the IRES inhibitors described herein are administered alone, and in alternative embodiments, the IRES inhibitors described herein are administered in combination with another therapeutic agent, e.g., another IRES inhibitor of the disclosure of different type (e.g., structure) or a completely different therapeutic agent.

In exemplary aspects, the IRES inhibitors described herein are administered in combination with a compound which targets one of the following genes: Bcat1, Bdkrb2, Bmp3, Ces1a, Chst1, Crabp1, Dapk1, Dbh, Foxq1, Gabbr2, Gfra1, Gnai1, Hsd11b1, IL17re, Iqsec3, Mb21d2, Mmp13, Nnat, Npy1r, Ntn1, Pmp22, Podx1, Prkcdbp, Ramp1, Rbp4, Reep1, Rgs10, S100a4, S100a5, S100a6, Sema3b, Sgce, Sh3bgr, Smoc2, Tbc1d9, Ugt8, V1d1r. The mRNA encoded by each of these genes are provided in the Sequence Listing as SEQ ID NOs: 64-137. In exemplary aspects, the IRES inhibitors described herein are administered in combination with a compound which targets a gene product encoded by one of these genes.

In alternative or additional aspects, the IRES inhibitors described herein are administered in combination with a compound which targets one of the following genes, which are related to neuron differentiation: Vgf, Ntn1, S1c11a, Lhx2, Nrp1, Mab2, Ret, Etv4, Btg2, Cspg5, Sptbn4, Rab3a, Lamb2, Celsr3, Ntrk1, Mapk8ip3, C1n8, Nnat, Bmp7, Brsk1, Sema5a, P1xna3, Fgfr1. In exemplary aspects, the IRES inhibitors described herein are administered in combination with a compound which targets a gene product encoded by one of these genes.

In alternative or additional aspects, the IRES inhibitors described herein are administered in combination with a compound which targets one of the following genes, which are related to the cell cycle: Suv39h2, Ndc80, Rad51, Trip13, Cenpf, Ccnb1, SMC4, SMC2, Kif11, Cep55, Kif18a, D1gap5, Lzts2, Katna1, Mih1, Mns1, Rps6. In exemplary aspects, the IRES inhibitors described herein are administered in combination with a compound that targets a gene product encoded by one of these genes.

In addition to the inventive methods comprising administering an IRES inhibitor, provided herein are alternative methods of treating SCA6 in a subject, comprising the step of administering to the subject (I) a compound which targets one or more genes other than the CACNA1A gene, wherein the one or more genes is selected from the group consisting of: Bcat1, Bdkrb2, Bmp3, Ces1a, Chst1, Crabp1, Dapk1, Dbh, Foxq1, Gabbr2, Gfra1, Gnai1, Hsd11b1, IL17re, Iqsec3, Mb21d2, Mmp13, Nnat, Npy1r, Ntn1, Pmp22, Podx1, Prkcdbp, Ramp1, Rbp4, Reep1, Rgs10, S100a4, S100a5, S100a6, Sema3b, Sgce, Sh3bgr, Smoc2, Tbc1d9, Ugt8, V1d1r, Vgf, Ntn1, S1c11a, Lhx2, Nrp1, Mab2, Ret, Etv4, Btg2, Cspg5, Sptbn4, Rab3a, Lamb2, Celsr3, Ntrk1, Mapk8ip3, C1n8, Nnat, Bmp7, Brsk1, Sema5a, P1xna3, Fgfr1, Suv39h2, Ndc80, Rad51, Trip13, Cenpf, Ccnb1, SMC4, SMC2, Kif11, Cep55, Kif18a, D1gap5, Lzts2, Katna1, Mih1, Mns1, and Rps6, or (II) a compound which targets a gene product encoded by said gene.

Kits

In some embodiments, the IRES inhibitor is provided as part of a kit or package or unit dose. "Unit dose" is a discrete amount of a therapeutic composition dispersed in a suitable carrier. Accordingly, provided herein are kits comprising an IRES inhibitor of the disclosure. In exemplary aspects, the kit comprises an antisense molecule as described herein.

In some embodiments, the components of the kit/unit dose are packaged with instructions for administration to a subject. In some embodiments, the kit comprises one or more devices for administration to a subject, e.g., a needle and syringe, a dropper, a measuring spoon or cup or like device, an inhaler, and the like. In some aspects, the IRES inhibitor is pre-packaged in a ready to use form, e.g., a syringe, an intravenous bag, an inhaler, a tablet, capsule, etc. In some aspects, the kit further comprises other therapeutic or diagnostic agents or pharmaceutically acceptable carriers (e.g., solvents, buffers, diluents, etc.), including any of those described herein. In particular aspects, the kit comprises an IRES inhibitor of the disclosure along with the current SCA6 standard of care.

Screening Methods

Additionally provided herein is a method of identifying a compound with SCA6 therapeutic activity. In exemplary aspects, the method comprises the steps of (i) contacting the compound with a sample comprising a nucleic acid molecule comprising at least a portion of the α1A mRNA, wherein the portion comprises at least the nucleotide sequence of the IRES of the α1A mRNA and the coding sequence of α1ACT, (ii) assaying for expression of α1ACT, wherein the compound is identified as a compound with anti-SCA6 therapeutic activity, when expression of α1ACT mRNA is reduced as compared to a control.

In exemplary aspects, the control is a control a compound which is known to not interfere with the expression of the α1ACT mRNA. In exemplary aspects, the control is a vehicle control. In exemplary aspects, when expression of α1ACT mRNA is reduced by at least 25%, relative to the control level of expression of α1ACT mRNA, the compound is identified as a compound with anti-SCA6 therapeutic activity. In exemplary aspects, when expression of α1ACT mRNA is reduced by at least 30% (e.g., at least 40%, at least 50%, at least 60%, at least 70%, at least 80%, at least 90%), relative to the control level of expression of α1ACT mRNA, the compound is identified as a compound with anti-SCA6 therapeutic activity.

In exemplary aspects, the nucleic acid molecule in the sample comprises at least a portion of the sequence of SEQ ID NO: 5. In exemplary aspects, the nucleic acid molecule in the sample comprises the coding sequence of α1ACT comprising the sequence of SEQ ID NO: 12. In exemplary aspects, the nucleic acid molecule in the sample comprises the sequence of the full length CACNA1A gene. In exemplary aspects, the nucleic acid molecule in the sample comprises the sequence of only a portion of the CACNA1A gene, but the nucleic acid sample comprises at least the IRES and the coding sequence of α1ACT. In exemplary aspects, the nucleic acid molecule in the sample comprises the sequence of the full length α1A mRNA, but the nucleic acid sample comprises at least the IRES and the coding sequence of α1ACT. In exemplary aspects, the nucleic acid molecule in the sample comprises only the IRES and the coding sequence of α1ACT.

In exemplary aspects, the sample comprises cells and the cells are engineered to comprise a reporter gene construct which is used to determine whether or not expression of the α1ACT coding sequence occurs. Many suitable reporter gene constructs are known in the art and include, for example, luciferase, green fluorescent protein (GFP), GUS, beta-galactosidase, choramphenicol acetyltransferase (CAT), and neomycin phosphotransferase. In exemplary aspects, the cells are engineered to comprise a luciferase reporter. In exemplary aspects, the cells are engineered to comprise a bicistronic gene reporter construct. In exemplary aspects, when the nucleic acid molecule in the sample comprises a full length CACNA1A gene, the reporter construct is a bicistronic gene reporter construct. In exemplary aspects, the bicistronic gene reporter construct is a Renilla-luciferase/Firefly-luciferase (R-Luc/F-Luc) bicistronic reporter construct. A description of an exemplary method of identifying a compound with SCA6 therapeutic activity is described herein in Appendix B.

In exemplary aspects, the sample does not comprise cells but comprises cell components necessary for in vitro translation. Methods of carrying out in vitro translation assays are known in the art. See, e.g., Kurita et al., Methods Mol Biol 905: 311-325 (2012); and Movahedzadeh et al., *Methods in Mol Biol* 235: 247-255 (2003). Following in vitro translation, the method in exemplary aspects comprises methods of assaying the levels of α1ACT mRNA expression. The method in some aspects comprises assaying for the level of α1ACT protein. Methods of determining the level of a protein are known in the art and include for instance Western blotting, radioimmunoassay, immunofluorescence, and the like. See, e.g., Green and Sambrook, *Molecular Cloning: A Laboratory Manual* (4$^{th}$ ed.), Coldspring Harbor Laboratory Press, Cold Spring Harbor, N.Y., 2012.

The following examples further illustrate the disclosure but, of course, should not be construed as in any way limiting its scope.

EXAMPLES

Examples 1 and 2 include information that was published on Jul. 3, 2013, as Du et al., *Cell* 154: 118-133 (2013).

Example 1

The following experimental procedures and materials were used in Example 2.

Materials and Standard Protocols

Cells, animals/mouse strains, antibodies, plasmids, and other materials were described in the Extended Experimental Procedures. The detailed protocols used for ChIP, ChIP-based cloning, ChIP-qRT-PCR, EMSA, Luciferase Assays, immunoprecipitation, immunohistochemistry, immunoblotting, quantitative RT-PCR, electrophysiology and LDH assay are outlined in the Extended Experimental Procedures.

Protein Purification and Mass Spectrometry

Protein extracts from HEK-293 cells stably transfected with α1A subunit bearing a Q11 allele were separated via anion exchange chromatography (His Trap FF column) and further purified by ANTI-FLAG M2 affinity purification. α1ACT$_{WT}$ fragment protein in SDS-PAGE gel was digested in-gel with trypsin and the resulting peptides were then analyzed via LC-MS/MS on an LTQ-Velos-Orbitrap mass spectrometer. See details in the Extended Experimental Procedures.

Immunohistochemistry and Microscopy

For detailed procedures of immunohistochemistry, antibodies and dilutions were described in the Extended Experimental Procedures. PC12 cells were imaged 0 hr, 24 hrs, 48 hrs and 72 hrs after NGF 24 hrs treatment. Neurites were defined as processes longer than the width of the cell body. For each experiment, cells were imaged. Dendrites were analyzed by employing ImageJ and NeuroJ programs.

Human Tissues

This study involves specimens from human subjects and was approved by the Institutional Review Board of the University of Chicago Medical Center. Written consents were obtained from all subjects prior to sample collection.

Plasmids

All clones were made from human calcium channel, voltage-dependent, P/Q type, α1A subunit (CACNA1A) cDNA (GenBank accession GI: 187828892, Millipore, Billerica, Mass., USA) as previous described (Kordasiewicz et al., 2006). All FLAG clones were generated with PCR with 3×FLAG (Supplemental Table 4 of Appendix A). PCR product and pCDNA3 vector (Invitrogen, Grand Island, N.Y., USA) were digested with BamHI and XbaI. α1A$_{WT}$, α1A$_{SCA6}$, α1ACT$_{WT}$ and α1ACT$_{SCA6}$ cDNA were ligated into the pCDNA3 expression construct. All mutations were performed via PCR (Quick-Change II XL Site-Directed Mutagenesis Kit, Stratagene, La Jolla, Calif., USA). Primers (Table 1) designed for the different BTG1 3'UTR and GRN 5'UTR were amplified from rat genomic DNA (Millipore, Billerica, Mass., USA). PCR products were inserted into pGL3 promoter vector by FseI and XbaI, and into pGL3 basic vector by XhoI and Mlu. Primers (Table 1) were designed to amplify different lengths of human α1ACT 5'-UTR based on identified translation start site and using pCDNA3-α1A$_{WT}$-FLAG as a template. Following digestion with EcoRI and NcoI, or MluI and NheI, the fragments were inserted into either the bi-cistronic reporter vector pRF (a gift from Dr. Anne E Willis) or the pGL3 basic vector (Promega, Madison, Wis., USA).

TABLE 1

Primers for Vectors

| Name | Sequence | Vector | SEQ ID NO |
|---|---|---|---|
| CTIREST1RNcoI | 5'atacCCATGGtggctgcgtagatcttcc3' | pRF | 13 |
| CTIRE889FEcoRI | 5'aatGAATTCctcatggctctgatccgca3' | pRF | 14 |
| CTIRE1353FEcoRI | 5'aatGAATTCtccaggccctcatgcttctc3' | pRF | 15 |
| CTIRE1388FEcoRI | 5'aatGAATTCtgaattatttc gcgatgcc3' | pRF | 16 |
| CTIREST1RH | 5'atacAAGCTTtggctgcgtagatcttcc3' | pGL3Basic | 17 |
| CTIRE889FMluI | 5'aatACGCGTctcatggctctgatccgca3' | pGL3Basic | 18 |
| CTIRE1353FMluI | 5'aatACGCGTtccaggccctcatgcttctc3' | pGL3Basic | 19 |
| CTIRE1388FMluI | 5'aatACGCGTtgaattatttccgcgatgcc3' | pGL3Basic | 20 |
| BTG1517Xba1F | 5'cgtaTCTAGAGATATAGTCTATGG ATGG3' | pGL3promoter | 21 |
| BTG1630FseIR | 5'GTAGGCCGGCCTCTATCTTGTGC CAGATC3' | pGL3promoter | 22 |
| BTG11150FseIR | 5'ATAGGCCGGCCTGGCTGGTGCT AACCACA3' | pGL3promoter | 23 |
| BTG11440FseIR | 5'cgcTGGCCGGCCCCAAGATAAGA ACAATT3' | pGL3promoter | 24 |
| BTG1517Xba1FDel1 | 5' cgtaTCTAGAGATATAGTCTATGGA TGGatcatc tggatagatt3' | pGL3promoter | 25 |
| BTG1517Xba1FMut1 | 5' cgtaTCTAGAGATATAGTCTATGGA TGGatcatcGCCtaatgga3' | pGL3promoter | 26 |
| BTG1517Xba1FMut2 | 5'cgtaTCTAGAGATATAGTCTATGG ATGGatcatc ttaCGCtgga3' | pGL3promoter | 27 |
| hGRNCP2F | 5'ctggccaacatggtgaaac3' | pGL3Basic | 28 |
| hGRNCP1B | 5'CCGGGTTCAA GCGATTCT3' | pGL3Basic | 29 |
| hGRNCP2B | 5'ccgggttcaa gcgattctc3' | pGL3Basic | 30 |
| α1 ACTF for in vitro | 5'ataaGGATCCAGCCACCATGCAG AAGACGCTA3' | pCDNA3 | 31 |
| α1 ACTR for in vitro | 5'GTATCTAGATTACTTGTCATCGT CATCCTTGTAGTCGATGTCATGAT CTTTATAATCACCGTCATGGTCTT TGTAGTCGCACCAATCATCGTCAG TCTCG | pCDNA3 | 32 |
| α1 ACTF for in vivo | aattgctagcgatgttccagaagacgggcacatggagt ccg | pTRE2 hyg2 | 33 |
| α1 ACTR for in vivo | aattatcgatctattagtgatggtgatggtgatggcacca atcatcgtcactctcgctgtaggg | pTRE2 hyg2 | 34 |

Antibodies

The primary antibodies used in the present study were mouse monoclonal anti-FLAG M2 antibody (clone M2, 1:1000, Sigma Aldrich, St. Louis, Mo., USA), rabbit polyclone anti-BTG1 antibody (1:1000, affinity isolated antibody, Sigma Aldrich), rabbit polyclone anti-PMCA2 (1:1000, affinity isolated antibody, Sigma Aldrich), monoclonal anti-GAP43 antibody (1:1000, Sigma Aldrich), anti-β-actin antibody (1:1000, Abcam, Cambridge, Mass., USA), anti-calbindin-28 kDa (1:250, Abcam), anti-Vglut1 (1:250, Abcam) and anti-Vglut2 (1:250, Abcam). Donkey HRP-conjugated anti-rabbit and anti-mouse IgG were used for secondary antibody detection for western blotting. Goat and donkey AlexaFluor405-, AlexaFluor488-, AlexaFluor555-, AlexaFluor594-, and AlexaFluor647-conjugated anti-mouse, anti-rabbit, anti-goat, and anti-rat IgG antibodies (Invitrogen, Grand Island, N.Y., USA) were used for secondary fluorescence detection for immunocytochemistry and immunohistochemistry.

Animals

Coding sequence of the C terminus of human calcium channel, voltage-dependent, P/Q type, α1A subunit carrying both normal range of polyQ ($\alpha1ACT_{WT}$) and pathological range of polyQ ($\alpha1ACT_{SCA6}$) were PCR amplified (Supplemental Table 4 of Appendix A) and cloned into pTRE-2hyg2-myc between NheI and ClaI sites. The transgenes were injected into C57BL/6 one-cell embryos and identification of transgenic founders was screened by PCR analysis of tail genomic DNA. The Pcp2-tTA transgenic mouse in which the tTA expression was driven by the Purkinje cell regulatory region from the murine Pcp2/L7 gene was obtained from Jackson Laboratory. To generate the conditional transgenic mouse models of PC-$\alpha1ACT_{WT}$ and PC-$\alpha1ACT_{SCA6}$, the two transgenic lines were crossed to make both genes in a single mouse. The null mouse defective in VDCC α1A subunit ($\alpha1A^{-/-}$) was obtained from Dr. Shin (Jun et al., 1999).

$\alpha1A^{-/-}$ mice and transgenic mice with an N-terminal myc epitope and expressing the $\alpha1ACT_{WT}$ and $\alpha1ACT_{SCA6}$ under control of the tetracycline response element in PCP2-tTA were housed in our animal facility. To investigate the importance of expression of the α1ACT fragment in Purkinje cells to the $\alpha1A^{-/-}$ phenotype we used the Pcp2 promoter and Tet-off system (Zu et al., 2004) to generate transgenic mice that have selective Purkinje cell expression of $\alpha1ACT_{WT}$ (Q4) (the smallest α1ACT polyQ seen in human) and $\alpha1ACT_{SCA6}$ (Q33) (the largest α1ACT polyQ seen in human) tagged with an N-terminal myc epitope. We bred transgenic mice (Pcp2-tTA) expressing the tetracycline transactivator protein, tTA (Zu et al., 2004), targeted to Purkinje cells with mice we developed bearing the TRE-α1ACT transgenes. Use of the Pcp2-tTa line facilitated generation of lines with comparable expression levels selectively in Purkinje cells, and provided the future prospect of pharmacological control of transgene expression, Pcp2-tTA/TRE-α1ACT (abbreviated, PC-α1ACT) double transgenic mice. To test the role of α1ACT in cerebellar Purkinje cell development in the absence of α1A channels, we bred PC-α1ACT mice with $\alpha1A^{+/-}$ heterozygous knockout mice and subsequently crossed these offspring to generate $\alpha1A^{-/-}$ mice with Purkinje cell-targeted α1ACT expression ($\alpha1A^{-/-}$/PC-α1ACT). Mice with the following genotypes were identified: $\alpha1A^{-/-}$, $\alpha1A^{+/-}$, $\alpha1A^{+/-}$/PC-$\alpha1ACT_{WT}$, $A^{+/-}$/PC-$\alpha1ACT_{SCA6}$ and $\alpha1A^{-/-}$/PC-$\alpha1ACT_{WT}$. Mouse lines were crossed to get $\alpha1A^{-/-}$/PC-$\alpha1ACT_{WT}$ and $\alpha1A^{-/-}$/PC-$\alpha1ACT_{SCA6}$ double transgenic mice. All animal experiments were approved and carried out in accordance with the regulations and guidelines for the care and use of experimental animals at the Institutional Animal Care and Use Committee of the University of Chicago.

Cell Culture and Established Stable Cell Lines

HEK-293 cells were maintained in MEME medium (ATCC, Manassas, Va., USA) containing 10% fetal bovine serum in a 37° C., 5% $CO_2$ incubator. PC12 cells (rat pheochromocytoma) were cultured in F-12K medium (ATCC, Manassas) supplemented with 10% horse serum and 2.5% fetal bovine serum (GIBCO, Grand Island, N.Y., USA) in a 37° C., 5% $CO_2$ incubator. Cells were transfected with pcDNA3 vectors expressing full-length constructs of the α1A subunit bearing both Q11 ($\alpha1A_{WT}$ and Q33 ($\alpha1A_{SCA6}$) allele, C terminal 3×FLAG tag with Q11 ($\alpha1ACT_{WT}$-FLAG), 3×FLAG tagged α1ACT with Q33 ($\alpha1ACT_{SCA6}$-FLAG) and empty pcDNA3 vector when they were <60% confluent using FuGene 6 reagent (Promega, Madison, Wis., USA). Stable cell lines were selected with 150 μg/ml and 300 μg/ml G418 (GIBCO) and cloned.

Isolation HEK-293 $\alpha1ACT_{WT}$FLAG Fusion Protein

HEK-293 cells stable expressing $\alpha1ACT_{WT}$ were maintained in MEME medium containing 10% fetal bovine serum (FBS) and G418, in a 37° C., 5% $CO_2$ incubator. For each labeling experiment, cells were harvested at the log phase (50-70% confluence). To obtain the cytosolic lysates of $\alpha1ACT_{WT}$ from HEK-293 cells, cells were pelleted by centrifugation and then resuspended in the 1×cell lysis buffer (Cell signaling) with proteinase inhibitor cocktail and 1 mM phenylmethanesulfonylfluoride (PMSF). Cell suspension was incubated on ice for 10 min and lysed by gentle pipetting. The lysates were centrifuged (10,000 rpm, 4° C.) and the supernatant (cytosolic lysate) was carefully transferred into a new tube on ice. Protein concentration was quantified with Promega Coomassie Plus™ Protein Assay Reagent (Promega, Madison, Wis., USA).

The crude protein lysis was loaded onto a HiTrap™ DEAE FF anion exchange chromatography column at a flow rate of 2.0 mL/min, which had been equilibrated with 20 mM HEPES buffer (pH7.0). The retained protein was eluted with a linear sodium chloride gradient (1-14=15%-80% NaCl in 20 mM Tris-HCl, gradient=5%) in the same buffer. The fraction from each elution was collected and eluted peaks (40% NaCl in 20 mM Tris-HCl, pH=8.0) were detected by western blotting with anti-FLAG antibody. The fractions from eluted peaks were subject to the second step purification.

Anti-FLAG M2 magnetic beads were washed with 5 packed gel volumes of TBS (1×) twice and used for affinity purification. Enriched fractions (2000 ml) from $\alpha1ACT_{WT}$ HEK-293 cytosolic lysate were mixed with 150 μl anti-FLAG M2 magnetic beads, and incubated for overnight at 4° C. The supernatant was removed and the beads were washed with 20 packed cold TBS. The sample was then mixed with Laemmli Sample Buffer (BioRad, Hercules, Calif., USA) and 5% (v/v) 2-mercaptoethanol, denatured at 96° C. for 5 min and separated on SDS-PAGE (5-20% Tris-HCl gel, 200 V, 1 hr) in 1× Tris-Glycine-SDS buffer (BioRad, Hercules, Calif., USA). Gel was stained for 2 hrs with GoldBlue (Thermo Fisher Scientific, Waltham, Mass., USA). Stain was discarded and the gel was de-stained with high purity water overnight until bands were observed. Gel was further de-stained using high purity water after which bands were excised and submitted for LD-MS/MS analysis.

Chromatin Immunoprecipitation (ChIP), ChIP-Cloning and ChIP-qRT-PCR

Anti-FLAG chromatin—immunoprecipitation (ChIP) was performed as Magna ChIP protocol described (Millipore, Billerica, Mass., USA). Target cells were crosslinked by adding of 1% (v/v) of formaldehyde to a cell monolayer in growth medium followed by an incubation for 10 min at 37° C. The crosslinking reaction was stopped by addition of 11% of the suspension volume of an ice cold 1 M solution of glycine. Media was removed and cells were washed twice with cold 1×PBS buffer. The cells were spun down immediately (4 min, 2000 g, 4° C.) and resuspended in cell lysis buffer (Millipore, Billerica, Mass., USA, 2×107 cells per 500 μl) with protease inhibitor and incubated for 15 min on ice with vortex briefly every 5 min. To shear the chromatin into pieces of a few hundred base pairs, the cell lysate was sonicated using a vibra cell sonifier (Thermo Fisher Scientific, Waltham, Mass., USA). The immunoprecipitation reaction was set up by combining 50 µl sonicated cell supernatant 10-fold in ChIP dilution buffer, 10 µg anti-FLAG M2 antibody and 20 µl of Protein G Magnetic beads for one ChIP reaction. This reaction was rotated overnight at 4° C. The beads were washed five times with wash buffer and TE-buffer using a magnetic particle concentrator (Millipore, Billerica, Mass., USA). The bound chromatin was eluted twice by addition of 50 µl of ChIP elution buffer to the beads followed by centrifugation. Eluted precipitates were then subjected to overnight digestion with restriction enzyme MboI. Candidate DNA sequences were subsequently recovered by reverse crosslink and proteinase K treatment. Extracted DNAs were cloned into MboI-digested cloning vector for sequencing. To predict the binding site of α1ACT, we performed alignments of ChIP-identified sequences using online software (CLC main workbench Version 6.5). For the ChIP-qRT-PCR, ChIP was performed again and precipitated DNA as template and designed PCR primers for the target genes (Table 2) were used in real-time quantitative PCR.

TABLE 2

Primers for ChIP Verification

| Name | Sequence | SEQ ID NO |
|---|---|---|
| BTG1CVF3 | 5'tgacagtgcc atagtttgga3' | 35 |
| BTG1CVR3 | 5'AAGTGTAAATAGTGCAAATTCCCC3' | 36 |
| GmCVF1 | 5'AAGACCATCATGGCCAACAT3' | 37 |
| GmCVR1 | 5'TTGGCTCAACACAACCTCC3' | 38 |
| PMCA2CVF1 | 5'TCTAGCCCTCCTTGCCTGGAA3' | 39 |
| PMCA2CVR1 | 5'TGGAGGTTGAATTTGGAAATT3' | 40 |

Transient Transfection

Transient transfections in HEK293, HeLa and COS-7 cells were performed by using TransIT 1 (Mirus, Pittsburgh, Pa., USA). Transfection in PC12 cells was performed by using Lipofection 2000 (Invitrogen, Grand Island, N.Y., USA), and transfections in SY5Y and N2A cells were performed by using Fugene 6 (Promega, Madison, Wis., USA) according to the manufacturer's instructions. siRNA duplexes (Supplemental Table 4 of Appendix A) were transfected into PC12 cells by using Lipofection2000 (Invitrogen, Grand Island, N.Y., USA) according to the manufacturer's instructions.

Nuclear Protein Extraction, Western Blot and Electrophoretic Mobility Shift Assays (EMSA)

Nuclear and cytoplasmic proteins were extracted from cell lines using NE-PER Nuclear and Cytoplasmic Extraction Reagents (Thermo Fisher Scientific). Expression of markers in nuclear and cytoplasmic protein was detected by western blot as described before (Du et al., 2009). Nuclear protein was incubated with biotin-labeled probes described in Table 3, then analyzed on a non-denaturing polyacrylamide gel as described previously (Du et al., 2009). For the supershift, 2 µg or 4 µg anti-FLAG antibody was incubated with nuclear protein in binding buffer for 1 hr at room temperature.

TABLE 3

Rat BTG1 probes for EMSA

| Name | Sequence | SEQ ID NO |
|---|---|---|
| BTG1 WT probe | 631ntGATCTTCACAGCTGTGACATGGTTATTCCAT AATCCATCCCCAAGAGGAGCCCACCCAAAGCAA AAAATCAAATCTATCCATCCATTATAAGATGATC CATCCATAGACTATAT517nt | 138 |
| BTG1-AT-rich probe | 553nt TCCATCCATTATAAGATGATCCA 531nt | 139 |
| BTG1-AT-rich mut1 probe | 553nt TCCATCCAgcgTAAGATGATCCA 531nt | 140 |
| BTG1-AT-rich mut2 probe | 553nt TCCATCCATTAgcgGATGATCCA 531nt | 141 |
| BTG1-AT-rich mut3 probe | 553nt TCCATCCATTATAAgcgGATGATCCA 531nt | 142 |
| BTG1-AT-rich mut4 probe | 553nt TCCATCCAgcggtcgcaGATCCA 531nt | 143 |
| BTG1-AT-rich mut1a probe | 553nt TCCATCCAaaaTAAGATGATCCA 531nt | 144 |
| BTG1-AT-rich mut2a probe | 553nt TCCATCCATTAaaaGATGATCCA 531nt | 145 |
| BTG1-AT-rich mut4a probe | 553nt TCCATCCAaaaaaaaaaGATCCA 531nt | 146 |
| BTG1-AT-rich mut1t probe | 553nt TCCATCCAtttTAAGATGATCCA 531nt | 147 |
| BTG1-AT-rich mut2t probe | 553nt TCCATCCATTAtttGATGATCCA 531nt | 148 |
| BTG1-AT-rich mut4t probe | 553nt TCCATCCAttttttttGATCCA 531nt | 149 |

Luciferase Assays

Cells were seeded into 24-well plates in triplicate and co-transfected with pRL-TK (Promega, Madison, Wis., USA) and the reporter pGL3 vector. Twenty-four hours later, luciferase activities were determined using the Dual-Luciferase Assay System as per manufacturer's instructions (Promega). The activities of Firefly and Renilla luciferase in lysates prepared from transfected cells were measured using the Dual-Luciferase Assay System and were measured by using a Wallac 1420 VICTOR 3 V luminometer with a 1 second integration time (Perkin Elmer, Waltham, Mass., USA). The activity of β-galactosidase in lysate prepared from cells co-transfected with pβ-Gal was measured using the same reader.

RNA Isolation and Quantitative Real-Time PCR (qRT-PCR)

Total cellular RNA or cerebellum RNA was isolated by RNeasy mini Kit or RNeasy lipid mini Kit (QIAGEN, Valencia, Calif., USA) according to the manufacturer's instructions. Complementary DNA was generated with SuperScriptIII reverse transcriptase (Invitrogen, Grand Island, N.Y., USA). The forward and reverse primers used in this study were listed in Supplemental Table 4 of Appendix A. Real-time PCR was performed as triplicates on iCycle Real-Time PCR system (Bio-Rad, Hercules, Calif., USA) and repeated at least three times. Each 20 μl reaction contained 0.1 μM primers, 4 mM MgCl$_2$ and SYBR GreenER Supermix (Bio-Rad, Hercules, Calif., USA), and was run under the following conditions: 95° C. 2 min; 95° C. 15 s, 58° C. 45 s for 55 cycles, followed by melting curve. The Ct value is defined as the cycle number at which the fluorescence crosses a fixed threshold above the baseline. As a relative quantification, fold changes were measured using the ΔΔCt method.

TABLE 4

Primers for RT-PCR

| Name | Sequence | SEQ ID NO |
|---|---|---|
| Mouse BTG-1F | 5' Gtgtccttca tctccaagtt cc 3' | 41 |
| Mouse BTG-1R | 5'gaagcctgaacaactcctgact3' | 42 |
| Mouse GranulinF | 5'ATG CCC CAG GCC TCT TGC TGT3' | 43 |
| Mouse GranulinR | 5'GGGTAGCTCACAGCAGGTAGA3' | 44 |
| Mouse PMCA-2F | 5'TGG CAT CAT ATT TAC CCT GCT T3' | 45 |
| Mouse PMCA-2R | 5'TTTCTTCTTGTCATCTGCATCG3' | 46 |
| rBTG-1F | 5'gattggactgagcagtcagga3' | 47 |
| rBTG-1R | 5'tcttaacctgatacagtcatc3' | 48 |
| rGRNrt-perF | 5'ACTTCCAGCTGCTGCCC3' | 49 |
| rGRNrt-perR1 | 5'ATACAGCAGGTGGCGGAG3' | 50 |
| rPMCA2rt-perF | 5'CTACTGTGGGAAGCTCAGGC3' | 51 |
| rPMCA2rt-perR | 5'GGGAACCACCTTCTCTCCTC3' | 52 |
| rTAF15940F | 5'CCCAGGACCAGTGAAGAAAG3' | 53 |
| rTAF18086R | 5'AAAGAGGAAGGGGCAATGAT3' | 54 |
| Exon 34-F | 5' ACAGTGATGA AGATGAGTTC CAAAT 3' | 150 |
| Exon 35-F | 5' GATAAGAACT CTGGCATCCT GACTC 3' | 151 |
| Exon 35-R | 5' ATGAAGGAAACAAAGTAAAAATAAGCA 3' | 152 |
| Exon 36-F | 5' GTCATCATGGACAACTTTGAGTACC 3' | 153 |
| Exon 36-R | 5' AGTCTCGGGTGAGGTACTCAAAG 3' | 154 |
| Exon 38-F | 5' GACAACACCGTCCACTTCAAT 3' | 155 |
| Exon 38-R | 5' AATCTTGATG TCCAGGGCTG T 3' | 156 |
| Exon 39-F | 5' CCGACAAACAGCAGATGGAC 3' | 157 |
| Exon 39-R | 5' CTAGCGTCTTCTGGGACAGATT 3' | 158 |
| Exon 40-F | 5' AGAGCAAGGCCAAGAAGCTG 3' | 159 |
| Exon 40-R | 5' CAGCTTCTTGGCCTTGCTCT 3' | 160 |
| Exon 41-F | 5' GGACACCCCTCATGTTCCAG 3' | 161 |
| Exon 42-F | 5' GAAAGCGGCCTCAAGGAGAG 3' | 162 |
| Exon 42-R | 5' CGTCTTCTGGAACATCTCCTG 3' | 163 |
| Exon 43-R | 5' AGTAGCCATCTCTGCCCATCT 3' | 164 |

Western Blot

Immunoblotting was performed on cell extracts and tissues as described previously (Kordasiewicz et al., 2006). Nuclear and cytoplasmic proteins were extracted from either cell lines or mouse cerebellum using NE-PER Nuclear and Cytoplasmic Extraction Reagents (Thermo Fisher Scientific, Waltham, Mass., USA). 50 μg of total protein or fraction were subjected to SDS-PAGE (6%, 8% or 12% TrisGlycine gel, Invitrogen, Grand Island, N.Y., USA) and transferred to a PVDF membrane (Millipore, Billerica, Mass., USA). The transblotted membrane was blocked with TBST containing 5% nonfat milk for 60 min and then incubated with the primary antibody at 4° C. overnight. The membrane was then probed with HRP-conjugated secondary antibody for 1 hr at room temperature and washed with TBST three times. Finally, the immunoblots were detected using a chemiluminescent substrate (Thermo Scientific Pierce Protein Biology Products, Rockford, Ill., USA) and visualized by autoradiography.

Immunoprecipitation

The lysates were pre-absorbed with Protein G-magnetic beads (Millipore, Billerica, Mass., USA) and then incubated with the anti-BTG1 in a binding buffer containing 50 mM Tris-Cl (pH7.5), 150 mM NaCl, 5% Glycerol, 1 mM DTT, 0.1% NP-40, 1 mM EDTA and protease inhibitors. The immune complex was captured with Protein G-Magnetic beads and washed as per manufacturers' instructions (Millipore, Billerica, Mass., USA). The immunoprecipitates were eluted with an SDS sample buffer and analyzed by immunoblotting.

Immunolabeling

Immunohistochemistry was performed as previously reported except as modified below (Kordasiewicz et al., 2006). Briefly, paraffin-embedded sections of perfused brains were de-waxed and rehydrated, then steamed for 20 min in antigen retrieval solution (Reveal; Biocare Medical, Walnut Creek, Calif., USA). Sections were blocked and exposed to primary antibody for 12 hrs at 4° C. After washing, fluorescent secondary antibody in PBS-T (phosphate buffered saline and 0.05% Tween-20) was added for 1 hr at room temperature. Confocal fluorescence microscopy was carried out under a TCS laser scanning microscope (Leica, Buffalo Grove, Ill., USA). Optical sections of 0.4 mm were scanned at the z-axis. Image J was used to quantify the percentage of specific expression of antibody in each sample. Immunocytochemistry of cell cultures was performed in PC12 cells on poly-L-lysine coated cover slips. Cells were fixed for 20 min in paraformaldehyde (PFA), washed three times in PBST, permeabilized with methanol-acetone at −20° C. freezer for 15 min, blocked 30 min in 10% donkey serum/TBS, incubated in primary antibody for 12 hrs at 4° C., washed three times in TBS, then incubated in secondary antibody either Alexafluor 568 or Alexafluor 488. Images were acquired with a TCS laser scanning microscope (Leica, Buffalo Grove, Ill., USA). All cells were imaged at the same settings. Intensity was determined with the brightest condition exhibiting little saturation (<255).

Height and density of Purkinje dendrite trees were calculated as previously described (Miyazaki and Watanabe, 2011). Purkinje cells selected for the measurements spanned the molecular layer were well-stained and were not obscured by adjacent cells. The dendritic trees of the captured Purkinje cell image and the area enclosed were outlined and measured using NIH Image J software. The cell body was excluded in the height measurements. The scale was consistently measured from the point where the cell body narrows into the primary dendrite. Height of the Purkinje cells (perpendicular height) was measured from the cell body in an axis perpendicular to the edge of the molecular layer. Following measurement of height, the identical Purkinje cell was used for density calculation, in which the same fluorescence pixel was used for all the Purkinje cells identified. For both measurements, 50-100 Purkinje cells were analyzed per animal to calculate the mean.

Electrophysiology

Slice preparation: Experiments were performed on $\alpha 1A^{-/-}$, $\alpha 1A^{-/-}/PC$-$\alpha 1ACT_{WT}$, and WT mice age P16-18. The animals were anesthetized with halothane and rapidly decapitated. The cerebellar vermis was then removed and cooled to 4° C. in artificial CSF (ASCF) containing the following (in mM): 124 NaCl, 5 KCl, 1.25 $Na_2HPO_4$, 2 $CaCl_2$, 26 $NaHCO_3$, and 10 D-glucose, bubbled with 95% $O_2$ and 5% $CO_2$. Parasagittal slices of the cerebellar vermis (220 µm) were prepared with a vibratome (VT-1000S; Leica Microsystems). Slices were then incubated for at least 1 hr at room temperature (RT) in oxygenated ACSF.

Somatic whole-cell patch clamp recordings: Slices were held at RT and continuously perfused with ACSF throughout the recordings. Patch-clamp recordings from Purkinje cells were performed using an EPC-10 amplifier (HEKA Electronics, Lambrecht-Pfalz, Germany). Currents were filtered at 3 kHz, digitized at 5-10 kHz, and acquired using Patchmaster software. To record PF EPSCs, patch pipettes (2-5 MΩ) were filled with a solution containing the following (in mM): 120 K-gluconate, 9 KCl, 10 KOH, 3.48 $MgCl_2$, 10 HEPES, 4 NaCl, 4 $Na_2ATP$, 0.4 $Na_3GTP$, and 17.5 Sucrose (pH 7.25-7.35). While cells were held in voltage-clamp mode at −80 mV, PF-EPSCs were elicited by a stimulating electrode placed in the upper third of the molecular layer. To record CF EPSCs, patch pipettes (2-5 MΩ) were filled with a solution containing the following (in mM): 100 $CsMeSO_4$, 50 CsCl, 1 $MgCl_2$, 0.2 EGTA, 10 HEPES, 2 $Na_2ATP$, 0.3 $Na_3GTP$, and 4 mM QX-314 (pH 7.25-7.35). Cells were held in voltage-clamp mode at multiple potentials. CF-EPSCs were elicited by a stimulating electrode placed in the granule cell layer. The presence of multiple CF innervations was ascertained by gradually increasing the stimulus intensity and looking for discrete changes, or steps, in EPSC amplitude, as has been described previously (Hashimoto et al., 2011). Picrotoxin (200 µM; Sigma-Aldrich, St. Louis, Mo.) was added to the ACSF throughout all recordings.

Data analysis: Data were analyzed with Excel (Microsoft) and Igor (Wavemetrics). All data are expressed as mean±SEM. For statistical analysis of PF and CF EPSCs, we used the unpaired Student's t test.

Cell Death Analysis

PC12 cells with stably-transfected pcDNA3-FLAG, $\alpha 1ACT_{WT}$-FLAG and $\alpha 1ACT_{SCA6}$-FLAG were washed extensively with serum-free, phenol red-free DMEM and an equal number of cells ($0.5 \times 10^6$) were plated into poly-L-lysine-coated 6-well plates. After 24-h, cells at basal culture conditions were collected and analyzed by flow cytometry with propidium iodide and annexin V-FITC staining. LDH release assay was also performed on these cells following the manufacturers' instructions (Roche, Indianapolis, Ind., USA).

Statistical Analysis

Values represent mean±standard error of the mean (SEM). Differences between experimental groups were compared by Student's t-test or ANOVA when multiple comparisons were made. For qRT-PCR, error was propagated using standard methods. For histopathology, significance was determined using the Student's t-test. For multiple comparisons, significance was assessed with the Mann-Whitney test. For the cell cycle, significance was analyzed via chi-square testing. Electrophysiological data were analyzed with Excel (Microsoft) or Igor (Wavemetrics).

Example 2

Identification of the C Terminal Fragment of CACNA1A-Encoded α1A Subunit (α1ACT)

Figure 8:
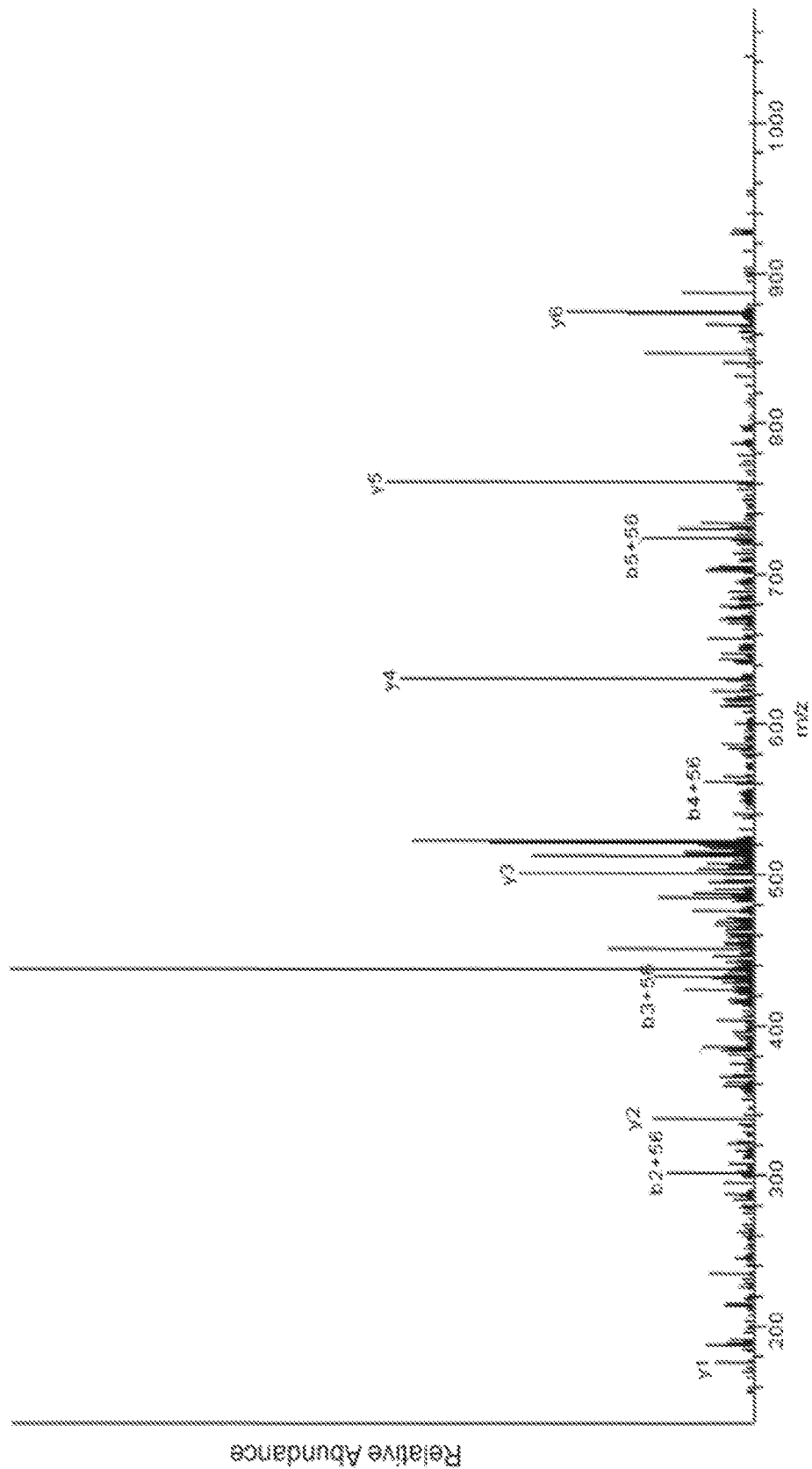
FIG. 8. LC-MS/MS detection of the starting site of α1ACT fragment (related to FIG. 1). Analysis of in-gel digest protein (The Rockefeller University Protein Resource Center, N.Y.) revealed that the starting amino acid sequence of N terminus of α1ACT fragment is Met Ile Met Glu Tyr (amino acids 1960-1964, nucleotide 6114-6128) (GenBank accession GI: 187828892, NM_001127222, NP_001120694).

To identify the N terminal sequence of the α1ACT fragment, we tagged the full-length human α1A subunit cDNA bearing normal polyQ (Q11), $\alpha 1A_{WT}$, at its 3' end with a 3×FLAG epitope and established HEK293 cell lines stably expressing this ~220 kD α1A-FLAG fusion protein. The cell line grew normally and stably expressed the 75 kD α1ACT-FLAG fusion protein. We affinity purified α1ACT-FLAG from the whole-cell lysate in a two-step procedure. Peak elution fractions (FIG. 1A) collected from anion exchange chromatography (HiTrap™ DEAE FF) were subjected to affinity purification using anti-FLAG M2 magnetic beads. The isolated α1ACT fragment protein was seen as a unique, 75 kD band (arrowhead) above the heavy chain IgG band on a Coomassie stained SDS-PAGE gel (FIGS. 1B and 1C). LC-MS/MS analysis of in-gel digest protein (The Rockefeller University Protein Resource Center, N.Y.) revealed that the amino acid sequence of N terminus of α1ACT fragment was Met Ile Met Glu Tyr (amino acids 1960-1964, nucleotides 6114-6128, Genbank access GI: 187828892, NM_001127222,) (FIG. 1D and FIG. 8). This sequence, which begins within the IQ-like domain of the full length α1A subunit and does not overlap with any known protease cleavage site, is a highly homologous sequence in all vertebrate species (Wilkins et al., 1999).

Figure 1E:
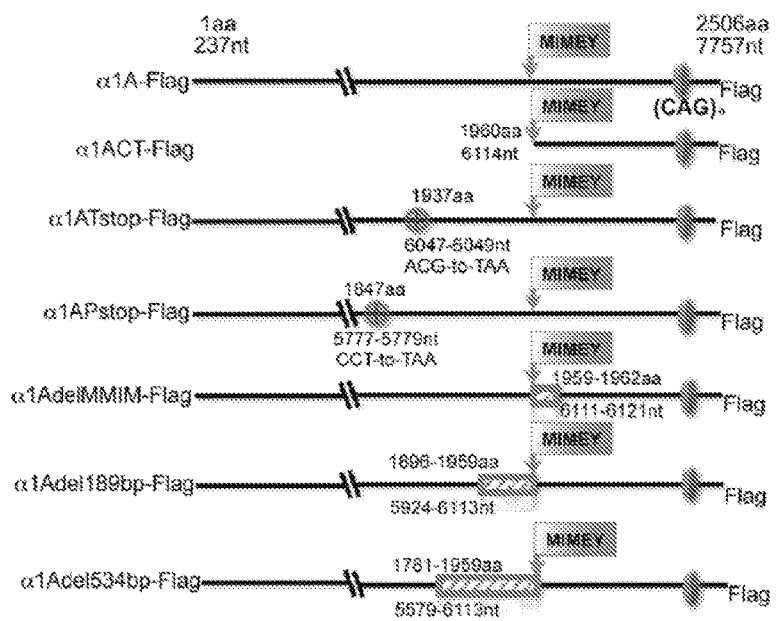
FIG. 1E is a schematic representation of the constructs with a series of mutations or deletions.
Figures 1F, 1G, 1H:
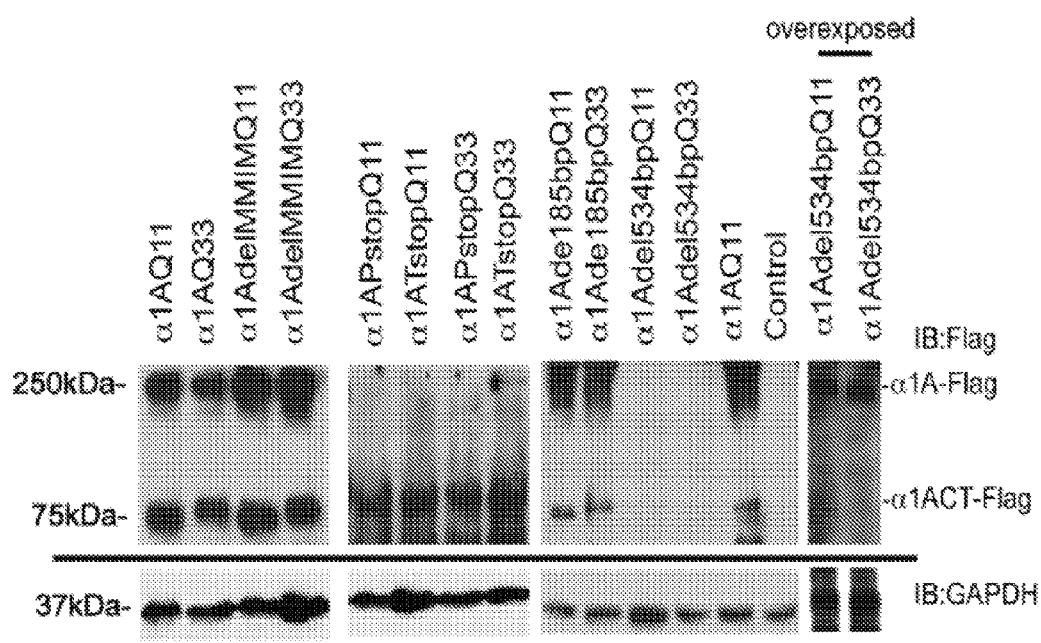
FIG. 1F illustrates that an in-frame deletion of the start site of α1ACT does not abolish the expression of the 75 kD C terminal portion of the FLAG-tagged α1A protein bearing either normal range (Q11) or pathological range (Q33) of polyQ.
FIG. 1G illustrates that expression of the 75 kD α1ACT C terminal fragment persists after insertion of termination codons at T1937 or P1847 in the FLAG-tagged α1A subunit, upstream of the start site.
FIG. 1H illustrates that deletion of a 534 bp fragment (α1Ade1534Q11), but not deletion of a 185 bp fragment (α1Ade1185Q11) from the α1A coding region upstream of the α1ACT eliminates α1ACT expression, while maintaining expression of full-length α1A-FLAG. Deletions using encoded Q33 repeat expansions constructs (α1Ade1185Q33 and α1Ade1534Q33) behave similar to the Q11 constructs (see also FIG. 8).

To investigate the origin of α1ACT protein fragment, we generated a series of constructs bearing different mutations of the α1A cDNA, as defined in FIG. 1E, and transfected them into HEK293 cells. Deletion of 534 bps (α1Adel534 bp) abolished the α1ACT fragment expression without affecting the expression of the full-length α1A subunit (FIG. 1H), whereas other mutations of α1A failed to do so (FIG. 1E-1H). This indicates that the 534 bps fragment upstream of the α1ACT start site in the α1A cDNA contains sequences essential for translation of α1ACT. These effects on expression were seen to an equivalent degree with both the $\alpha 1A_{WT}$ and the human α1A subunit cDNA bearing the pathological polyQ tract (Q33, $\alpha 1A_{SCA6}$)

CACNA1A mRNA Contains an Internal Ribosome Entry Site (IRES)

Figures 9A, 9B, 9C:
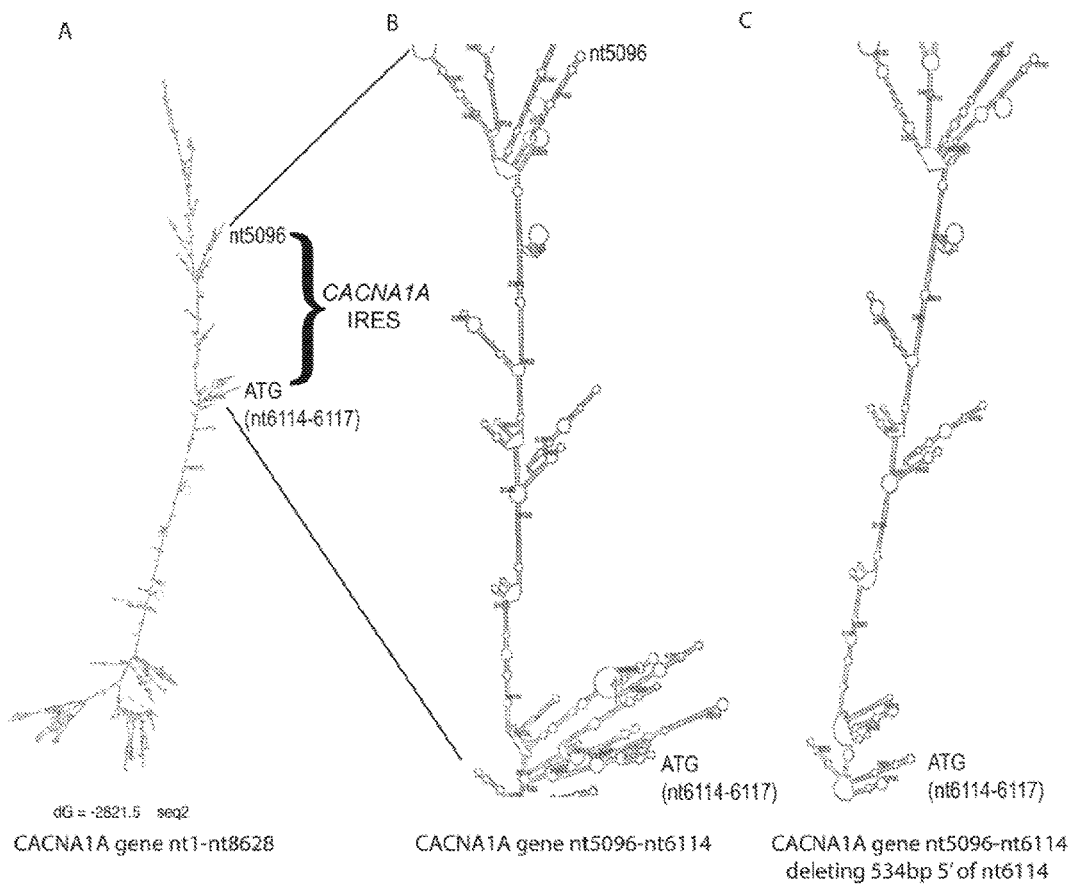
FIG. 9. Predicted secondary structure of CACNA1A IRES (related to FIG. 2) (A) Optimal secondary structure of human CACNA1A RNA is determined by energy minimization analysis using the mFold (dG=−2821.5 kcal/mol; plt22ps by D. Stewart and M. Zuker, 2010). The CACNA1A IRES 1014T region exhibits several independently folding domains located around the α1ACT translation initiation site. (B) The amplified image of RNA structure of CACNA1A IRES as determined by mFold. (C) The amplified image of RNA structure of CACNA1A IRES, after deleting 534 bp 5' of the start codon ATG (1960), as determined by mFold. Color coded by observed pairing number (red=high stability, blue=low stability).

We hypothesized that expression of α1ACT fragment may be mediated by an IRES present within the CACNA1A coding sequence. 2-d structure analyses of the complete α1A mRNA sequence using an M-fold-based algorithm (Palmenberg and Sgro, 1997; Zuker, 2003) did not identify any canonical type I or type II IRES structures in this region (Baird et al., 2006). However, the region containing nucleotides 5096-6110 sequence was predicted to form a highly complex, stable conformation possessing several stem-loop structures that could represent an area of functional significance for ribosomal binding and interaction with trans-activating factors (FIG. 9). This region is highly conserved, from 89.4% in Bos taurus to 76.7% in Danio rerio.

Figure 2H:
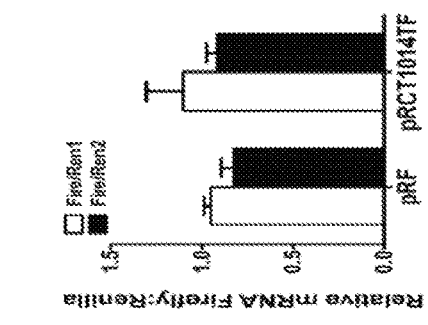
FIG. 2H: Quantitative, real-time reverse transcription-PCR (qRT-PCR) performed using RNA from cells transfected with bi-cistronic vectors as amplified using primers, Ren1, Ren2 and Fire demonstrates no difference in abundance of R-Luc and F-Luc mRNA. (I and J) qRT-PCR performed using RNA extracted from PC12 and HEK293 cells, transfected with α1A or human cerebellum to compare abundance of amplicons Ex34-35, Ex38-39 and Ex39-40, upstream of the α1ACT start site relative to amplicons Ex41-42 (I) and Ex41-43 (J), from within the α1ACT coding region. Data are mean±SEM, n≥3 (each involving triplicate assays, *p<0.05, **p<0.01). (see also FIG. 9).
Figure 2I:
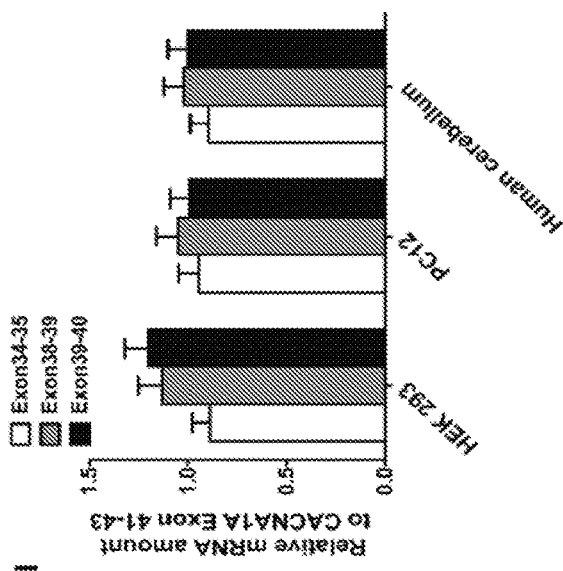
FIG. 2 relates to CACNA1A mRNA containing an IRES.
FIG. 2A is a schematic representation of the constructs pRF and pRCTTF.
FIG. 2B illustrates that IRES activity is demonstrated using bi-cistronic vectors. The ratio of Renilla luciferase and firefly luciferase activities was determined and normalized to β-galactosidase activities.
FIG. 2C illustrates the sequence of CACNA1A IRES nucleotide inserts CTT, CTmut1 and CTmut2, insertion of 1-2 nucleotides. The three sequences in FIG. 2C are presented in the Sequence Listing as SEQ ID NOs: 167-169 (top sequence to bottom sequence, respectively).
FIG. 2D illustrates that the luciferase activities of bi-cistronic vectors bearing nucleotide insertions are determined as in FIG. 2B.
FIG. 2E is a schematic representation of the constructs pGL3Basic and pGL3BasicCT. The same DNA fragments as inserted into pRF were subcloned into the promoter-less pGL3Basic construct.
FIG. 2F illustrates Luciferase activities, which are determined as in FIG. 2B.
FIG. 2G shows that the raw firefly luciferase activities of two fragments are compared between promoter-less vector pGL3BasicCT and bi-cistronic vector pRCTTF, which suggests 1014 bp fragment contains an IRES.
Figure 2J:
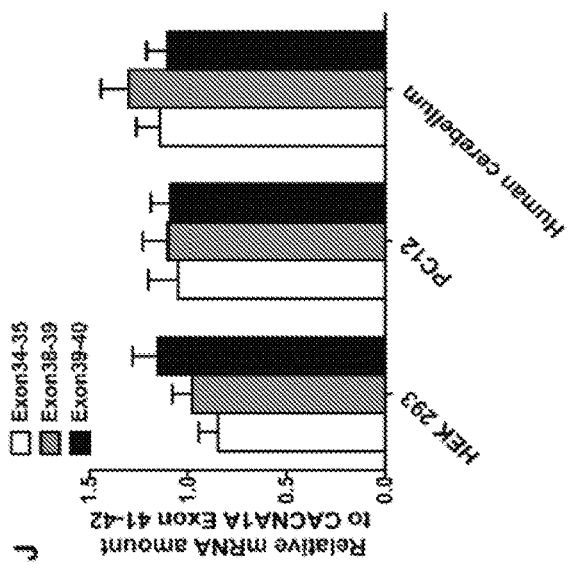

To test for IRES activity within this region we inserted DNA segments of different lengths (FIG. 2) from the region 5' to the α1ACT start site into the bi-cistronic (Renilla luciferase, R-Luc, and firefly luciferase, F-Luc) reporter vector, pRF (FIG. 2A) (Spriggs et al., 2009). Because the coding region for the R-Luc is followed by a stop codon, an increase in F-Luc activity indicates the presence of an upstream IRES that enables re-binding of the dual luciferase transcript to the ribosomal machinery. Expression of pRCT653TF or pRCT1014TF, but not pRCT189TF and pRCT293TF, in HEK293 cells enhanced the activity of the F-Luc approximately 9- and 26-fold (FIGS. 2A and 2B). Moreover, insertion of 1 or 2 nucleotides immediately 5' to the ATG codon prior to the F-Luc coding region within the pRF vector eliminated the accumulation of F-Luc (FIGS. 2C and 2D). Therefore, the structure of the CACNA1A IRES is highly dependent on initiating translation of the second cistron at a specific codon, ATG 1960, as is typical of most IRES activation (Fitzgerald and Semler, 2009; Wilson et al., 2000). To help exclude the possibility that the increased F-Luc activity was due to a change at the RNA level, we inserted the same segments into the promoter-less reporter vector, pGL3Basic. Transfection into HEK293 cells yielded no significant increase of luciferase activity (FIG. 2E-2G), arguing against the presence of a cryptic promoter in these segments. Subsequently, we performed a quantitative real-time PCR (qRT-PCR) on two amplicons within the Renilla ORF and one near the initiation codon of firefly ORF (FIG. 2A). The observed ratio of 1:1 Renilla: Firefly mRNA (FIG. 2H) favors the presence of an IRES, rather than increased transcription of the second reporter via a cryptic promoter, a splicing event or any other increase in mRNA stability. In addition, the qRT-PCR expression ratios for gene fragments (5' to or 3' to the α1ACT start site) within the α1A subunit were approximately 1 in untransfected HEK293 or PC12 cells. Lastly, we found equivalent signals from before and after the α1ACT start site using endogenous α1A mRNA isolated from human cerebellum (FIGS. 2I and 2J). These results suggest that expression of α1ACT is driven by the presence of a cellular IRES within the α1A coding region rather than by a cryptic promoter or splicing event.

Figure 3A:
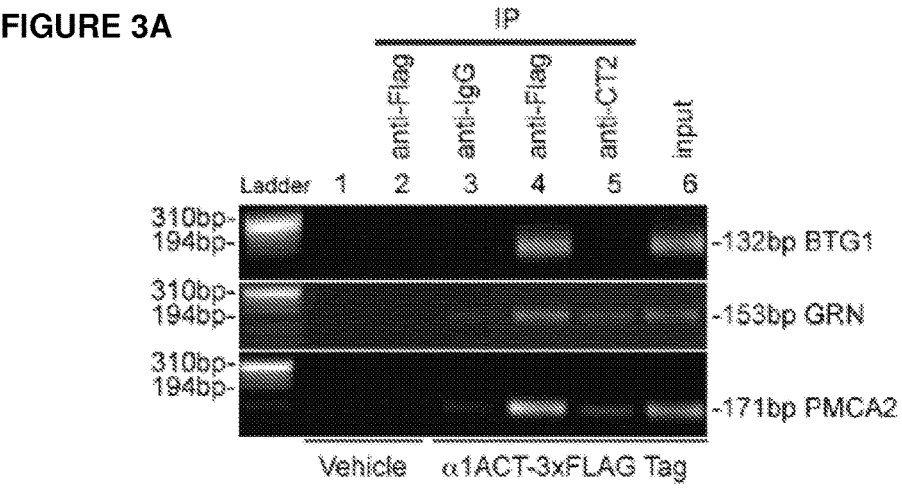
FIG. 3. α1ACT is a transcription factor that regulates neural gene expression through an AT-rich element (A) ChIP and quantitative real-time PCR verification of DNA sequences identified by ChIP-cloning. PC12 cells were transfected with empty vector or FLAG-tagged α1ACT$_{WT}$. (B) Relative enrichment was calculated as the ratio between the net intensity of each bound sample normalized to its input sample, and the vehicle control sample normalized to vehicle control input sample (n≥3). (C) Enhancer activity of BTG1 gene fragments. Positions of the fragments are indicated. (D) Promoter activity of GRN gene fragments. Positions of the fragments are indicated. (E) Consensus sequence analyzed by CLC main workbench Version 6.5 among the α1ACT ChIP-targeted sequences. Consensus sequence was predicted and labeled in red. The sequences of FIG. 3E are presented in the Sequence Listing as SEQ ID NOs: 170-174 (top sequence to bottom sequence, respectively). (F) EMSA demonstrates the formation of displaceable nucleoprotein complex with the α1ACT and BTG1 WT (517-630nt) element. Lane 1 is biotin-labeled BTG1 WT probe. Lanes 2 and 5 show the three major complexes formed between BTG1 probe and α1ACT$_{WT}$ nuclear protein. Lane 8 shows the fourth complex formed between BTG1 probe and α1ACT$_{SCA6}$ nuclear protein. (G) EMSA shows that the AT-rich probe (531-553nt) forms three complexes in the absence of competitor. These complexes were displaced by excess unlabeled AT-rich sequence and partially abolished by AT-rich Mut1 and Mut3. The super-shifted bands were only seen in α1ACT$_{WT}$-FLAG nuclear extracts treated with FLAG-M2 antibodies, but not in lane of pCDNA3 nuclear extracts. (H) EMSA shows that the TTATAA region is critical for the formation of nucleoprotein complexes with AT-rich element. (I) α1ACT$_{WT}$ significantly increases BTG1 enhancer activity through intact TTATAA region. Plasmid pRL-TK is used as transfection efficiency control. Data are mean±SEM, n≥3 (each involving triplicate assays, *p<0.05 vs. control construct) The sequences of FIG. 3I are presented in the Sequence Listing as SEQ ID NOs: 175-178 (top sequence to bottom sequence, respectively). See also FIG. 10.
Figure 3B:
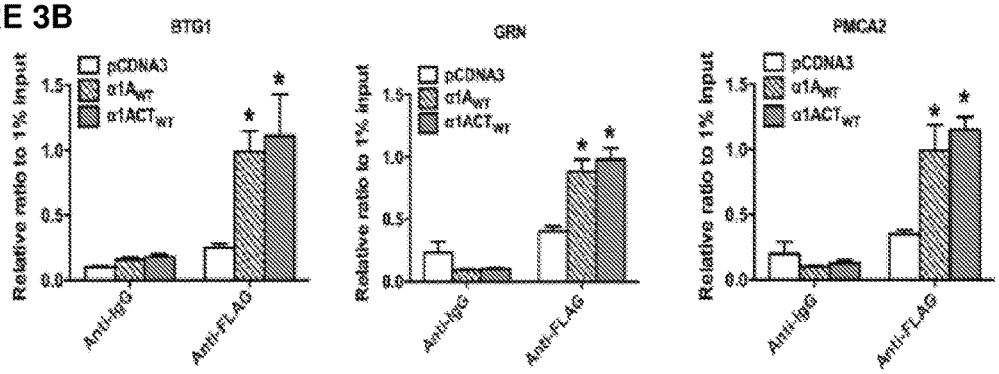

The Translocated α1ACT Fragment Binds to Non-Coding Regions of Genes Expressed in Purkinje Cells and Activates Transcription Earlier studies indicated that the 75 kD α1ACT, bearing the normal polyQ tract, was enriched in the nucleus (Ishiguro et al., 2010; Kordasiewicz et al., 2006). To investigate whether α1ACT$_{WT}$(Q11) plays a role in gene expression by binding to genomic DNA, we performed chromatin immunoprecipitation-based cloning (ChIP-based cloning) from PC12 cells transfected with α1ACT-FLAG fusion protein (Methods). Potential target genes identified via ChIP-based cloning and sequencing include GRN (granulin), BTG1 (B-cell translation gene 1), PMCA2 ($Ca^{2+}$ ATPase, plasma membrane 2), ITGA8 (integrin alpha-8 precursor) and TAF1 (TATA box binding protein-associated factor of RNA pol II) (Table 5). Putative interaction between α1ACT-FLAG fusion protein and cloned DNA segments within the BTG1, PMCA2 and GRN genes was further confirmed by ChIP-qRT-PCR, (FIGS. 3A and 3B). Although these genes are not uniquely expressed in PCs, the abundant expression of α1ACT in PCs suggests that they are part of a PC-specific developmental program.

TABLE 5

The neuronal genes identified by α1ACT ChIP-cloning

| Name | Short Name | Genebank Accession | Length (bp) | Position |
|---|---|---|---|---|
| TATA box binding protein-associated factor | TAF1 | NG_012771 | 171 | Introns Alu repeat |
| B-cell translocation gene 1 | BTG1 | NM_017258 | 100 | 3'UTR532-631 nt |
| Granulin | GRN | NG_007886 | 153 | 5'UTR 6793-6930 bp |
| $Ca^{2+}$ ATPase, plasma membrane 2 | PMCA2 | NM_012508 | 186 | 5'upstream 9822 bp |
| Integrin α-8 precursor | ITGA8 | EF444991 | 1227 | Intron 22 153367-154427 |

Figure 3C:
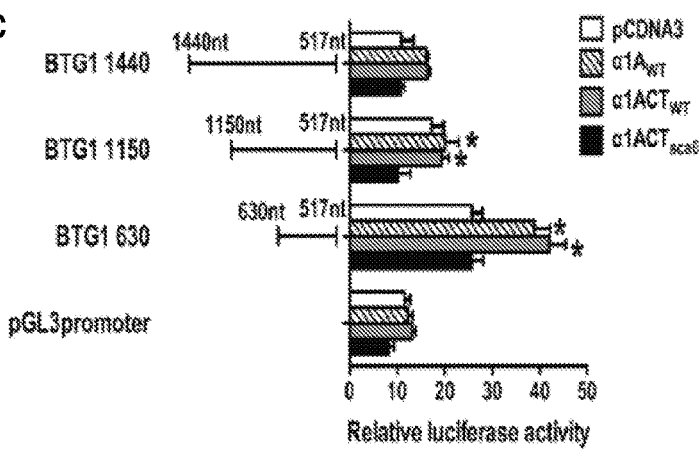
Figure 3D:
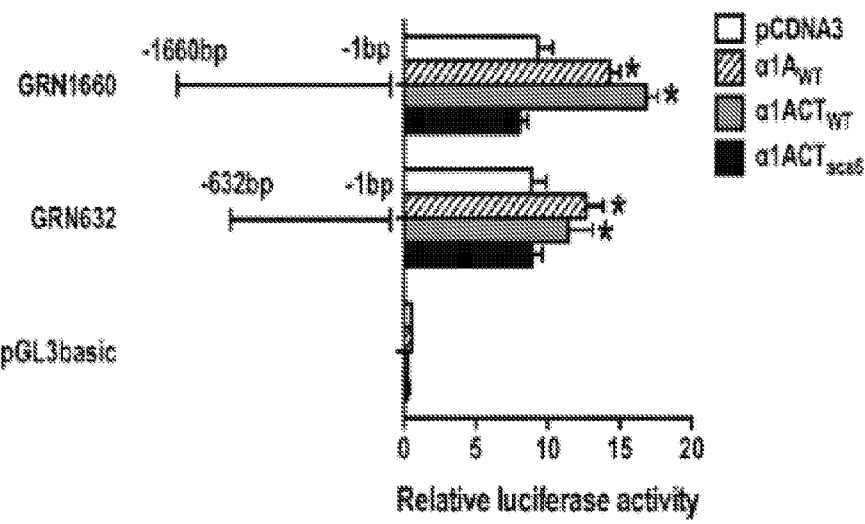

We tested whether α1ACT regulates gene expression through the target sequences identified in ChIP-based cloning. Within BTG1 3' UTR, we identified an enhancer within the 113 bp sequence that obtained from α1ACT ChIP-based cloning, using reporter assays with segments spanning three lengths (beginning at nt 517) from the 3' UTR inserted into the pGL3 promoter vector (Du et al., 2009), as shown in FIG. 3C. Importantly, over-expression of α1ACT$_{WT}$ significantly increased luciferase activity in the BTG1-630 reporter construct, suggesting that BTG1 3'UTR contains an α1ACT-regulated enhancer element. However, α1ACT$_{SCA6}$, bearing the pathological polyQ tract (Q33) failed to increase BTG1 3'UTR-enhanced luciferase expression (FIG. 3C). We obtained similar results from two segments of 5' flanking region in the progranulin gene using the pGL3-basic vector. The α1ACT$_{WT}$ fragment, but not the Δ1ACT$_{SCA6}$ fragment, increased expression of the reporters bearing the 1662 bp fragment by 2-fold and the 638 bp fragment by 3.2-fold, respectively (FIG. 3D). Thus, α1ACT$_{WT}$ has direct gene regulatory effects on at least two target genes, and these are lacking with α1ACT$_{SCA6}$.

Figure 3E:
Figure 3F:
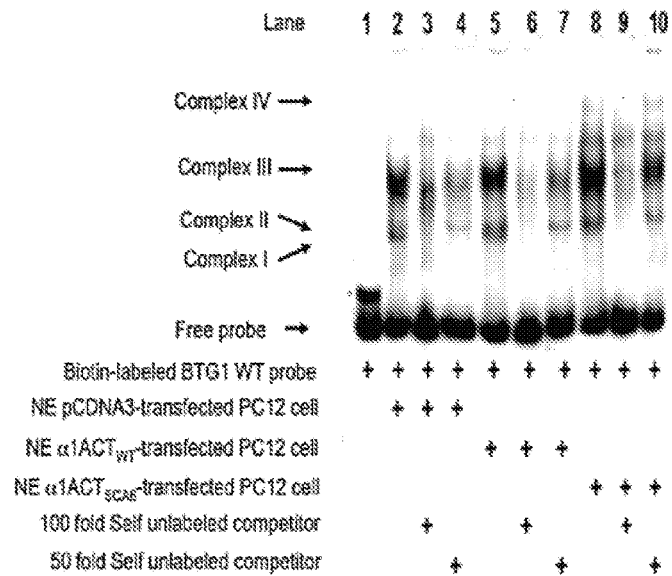

AT-Rich Element of α1ACT Binding Site is Essential for the BTG1 Enhancer Activity Alignments of ChIP-identified sequences predict two distinct motifs, 1) an AT-rich element, TTATAAAA, and 2) a CA-rich element, CCAA, as potential α1ACT binding sites (FIG. 3E). The 113 bp BTG1 3' UTR sequence (517-630 bp BTG1 WT, Table 3) contains both consensus sequences. As shown in FIG. 3F by electrophoretic mobility shift assays (EMSA) using the BTG1 WT as probe and nuclear extracts from untreated PC12 cells or from those transfected with α1ACT$_{WT}$ and α1ACT$_{SCA6}$, we observed a component in PC12 cells, caused a significant gel shift (Complex I, II and III). This indicates that the BTG1 3' UTR contains cis-elements reacting with neuron-specific nuclear protein, present in both untransfected and α1ACT-transfected cells. The three protein complexes with the BTG1 WT probe could be abolished by excess unlabeled BTG1 WT probe, indicating that the binding was specific (Lanes 3 and 4, FIG. 3F). Interestingly, nuclear extracts from α1ACT$_{SCA6}$-transfected PC12 cells (Lane 8, FIG. 3F) led to a different migration and pattern of DNA-protein complexes compared to α1ACT$_{WT}$-expressing cells (Lane 5, FIG. 3F), with a greater abundance of complex IV in complexes from the α1ACT$_{SCA6}$-transfected PC12 cells. This suggests that α1ACT$_{SCA6}$ has different protein binding pattern from α1ACT$_{WT}$.

Figure 3G:
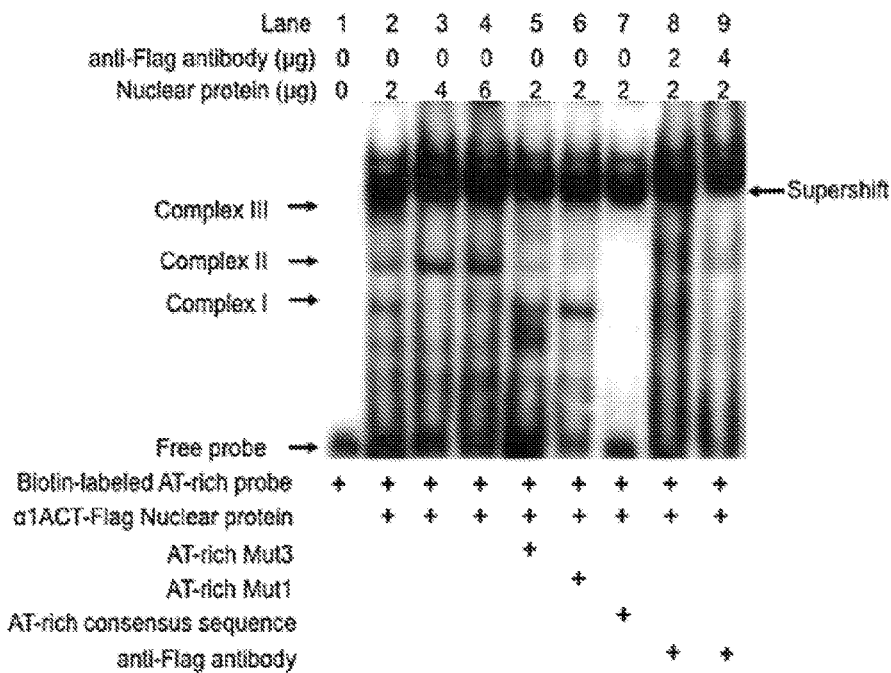
Figure 3H:
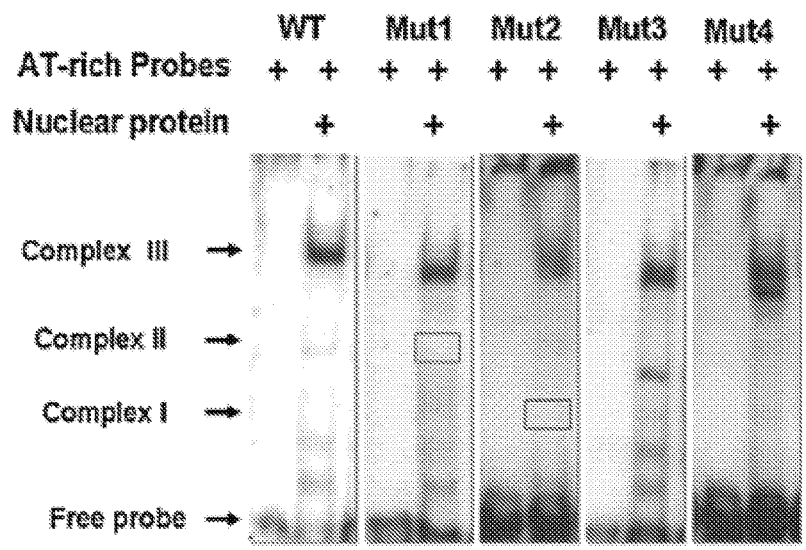
Figure 3I:
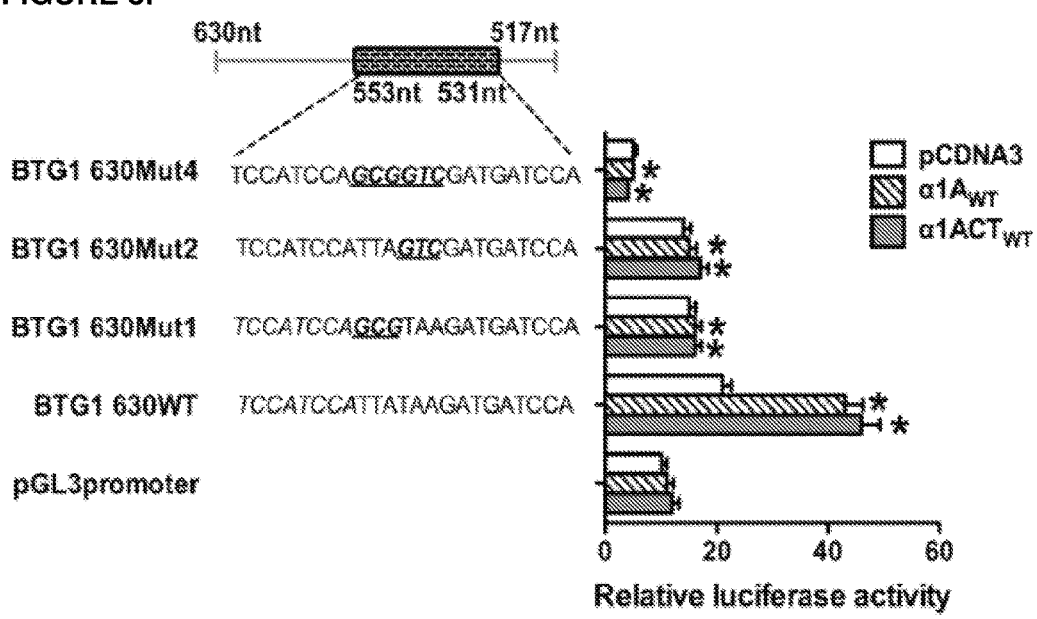
Figure 10:
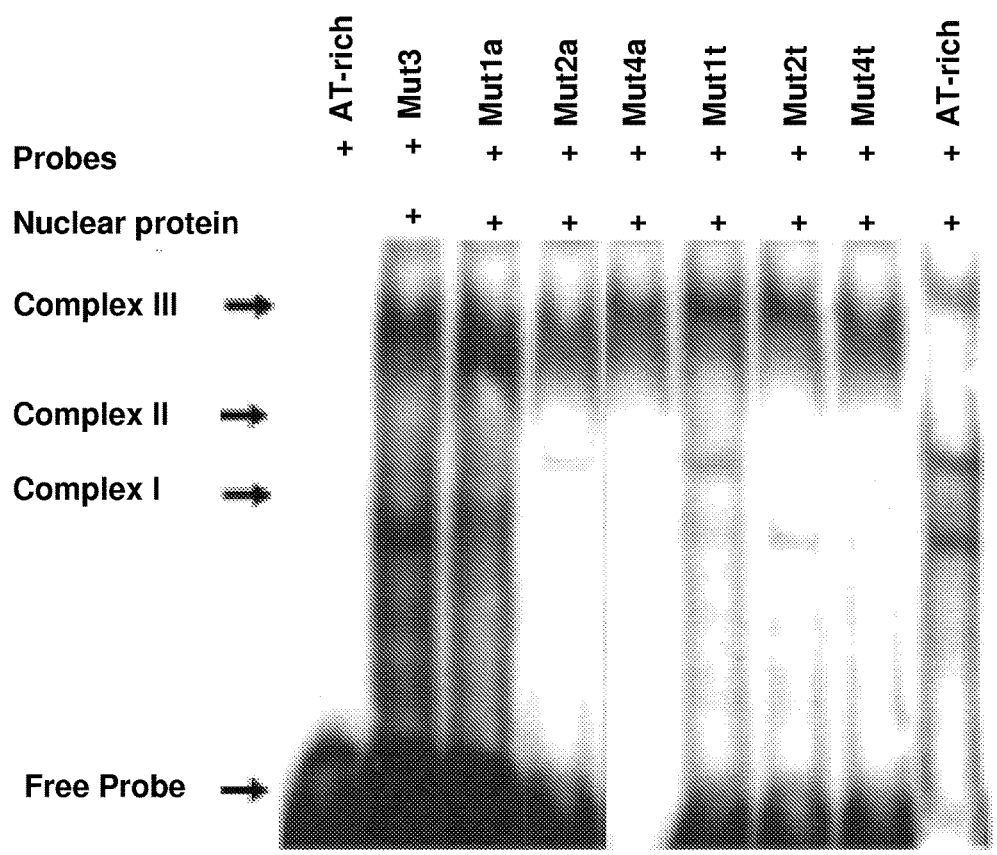
FIG. 10. EMSA shows that the TTATAA region is critical for the formation of nucleoprotein complexes with AT-rich element (related to FIG. 3) Double-stranded, 3' biotin-labeled probes corresponding to the AT-rich element and mutations of AT-rich element (Mut1t, Mut1a, Mut2t, Mut2a, Mut3, Mut4t and Mut4a) were incubated with PC12-α1ACT$_{WT}$-Flag nuclear extracts. Mut1t and Mut1a abolished complex II, and Mut2t and Mut2a abolished complex I. Mut4t and Mut4a, combined with Mu1t and Mut2, abolished both complexes I and II. Mut3 had no effect on protein/DNA complexes.

To further identify α1ACT consensus sequences, we used the AT-rich consensus element as a probe in EMSA (Table 3 and FIG. 3G). The AT-rich consensus sequence greatly reduced the formation of the complexes (Lane 7, FIG. 3G), while mutant AT-rich elements only partially reduced the complex formation (Lanes 5 and 6, FIG. 3G). Anti-FLAG antibodies generated a super-shifted complex with nuclear extracts from α1ACT$_{WT}$-FLAG expressing cells (Lanes 8 and 9, FIG. 3G). These studies demonstrate that α1ACT binds to AT-rich element in the BTG1 3' UTR. Finally, we performed EMSA with a series of 3-bp mutations of the TTATAAGAT sequence (Table 3). As shown in FIG. 3H, Mut1 abolished complex II and Mut2 abolished complex I. Mut4, combining Mut1 and Mut2, abolished both complex I and II (FIG. 10). We also mutated the element, TTATAAGT, within the BTG1 630reporter construct (517-630 bp). Constructs 630mut1 and 630mut2 contain 3 bp mutation, while 630mut4 contains both Mut1 and Mut2 substitutions. All three constructs had significantly reduced luciferase activities, both basally and in response to over-expressing of α1ACT$_{WT}$ compared to BTG1 630 construct (FIG. 3I). These results suggest that TTATAA is the core sequence of AT-rich element that is required to maintain the α1ACT-regulated BTG1 expression.

Figure 4A:
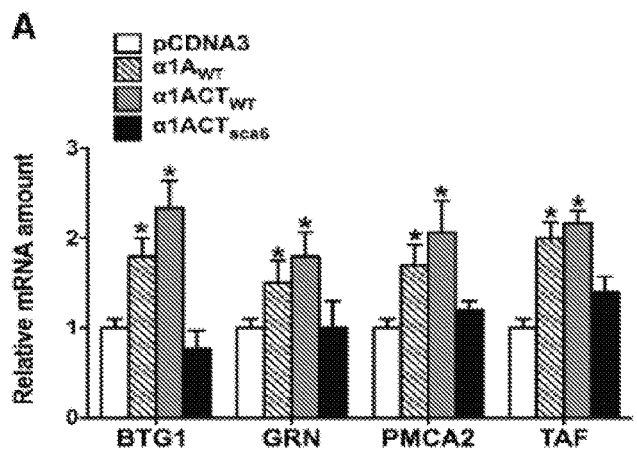
FIG. 4. α1ACT enhances neurite outgrowth by regulating BTG1 expression (A) Relative mRNA expression levels of BTG1, PMCA2, TAF and GRN in PC12 cells transfected with α1A$_{WT}$, α1ACT$_{WT}$ or α1ACT$_{SCA6}$ (n≥3). (B and C) Western blot (B) and quantitation of protein expression levels of BTG1 and PMCA2 in PC12 cells transfected with α1A$_{WT}$, α1ACT$_{WT}$ and α1ACT$_{SCA6}$ (C). (D) Relative levels of BTG1 mRNA in the cerebellum from two SCA6 patients, normalized to Pcp2. (E and F) α1ACT$_{WT}$ enhances neurite outgrowth. Representative low- and high-magnification images of PC12 cells with transiently transfected pcDNA3-FLAG, α1A$_{WT}$-FLAG, α1ACT$_{WT}$-FLAG and α1ACT$_{SCA6}$-FLAG at 24 hr (E) and 72 hr after NGF treatment (F). Cells were labeled for GAP-43 (green) to visualize PC12 cell body and neurites. (G and H) Quantitation of average neurite length and percentage of neuritis per cell (n=200; *p<0.05 versus pcDNA3-FLAG). (I) α1ACT$_{WT}$ up-regulates BTG1 gene and increases PRMT1/BTG1 protein interaction. (J and K) Silencing of BTG1 expression inhibits α1ACT$_{WT}$-enhanced neurite outgrowth. Anti-FLAG staining is shown in red. (L) Quantitation of neurite outgrowth by siBTG1 in transfected cells (n=3, *p<0.05). The blunted effect by α1ACT$_{SCA6}$-FLAG was also diminished by BTG1 silencing. Data are mean±SEM (see also FIG. 11).
Figure 4B:
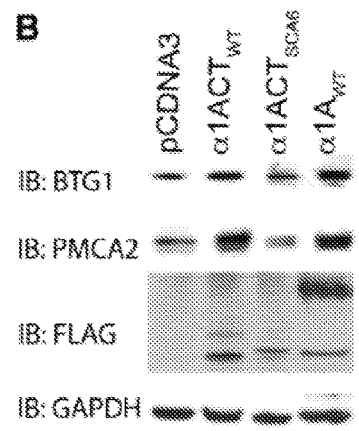
Figure 4C:
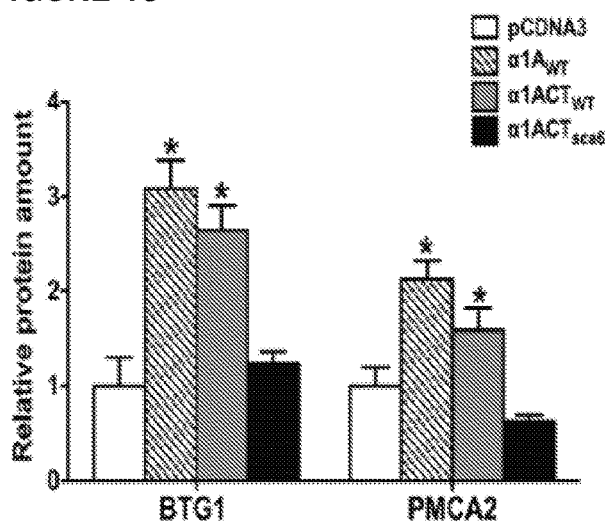
Figure 4D:
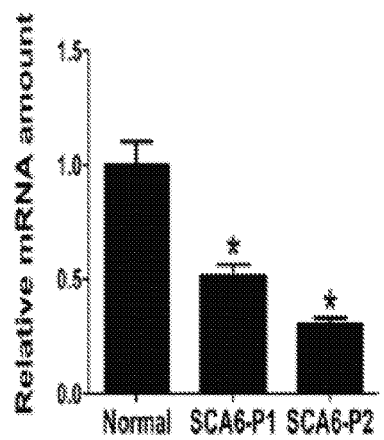

The α1ACT$_{WT}$ (but not α1ACT$_{SCA6}$) Increases the Physiological Expression of Target Genes and Enhances Neurite Outgrowth of Differentiating PC12 Cells To test for an effect of α1ACT on endogenous expression of ChIP-identified genes we examined the mRNA and protein levels of TAF, BTG1, PMCA2 and GRN in both cell lines and human cerebellum. Over-expression of normal α1A$_{WT}$ or α1ACT$_{WT}$, but not α1ACT$_{SCA6}$, significantly increased the expression of these genes (1.6- to 2.7-fold) in PC12 cells, either compared to empty vector-transfected or α1ACT$_{SCA6}$-transfected PC12 cells (FIG. 4A). As shown in FIGS. 4B and 4C, BTG1 and PMCA2 protein expression levels were also increased in α1A$_{WT}$- and α1ACT$_{WT}$-transfected PC12 cells. Finally, using cerebellar tissues from two SCA6 patients (Q22) and normalizing transcript levels to a PC specific mRNA, Pcp2, we found that BTG1 gene mRNA expression was decreased compared to the normal control (FIG. 4D).

Figure 4E:
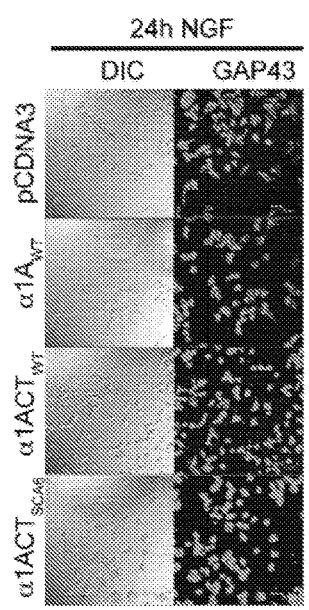
Figure 4F:
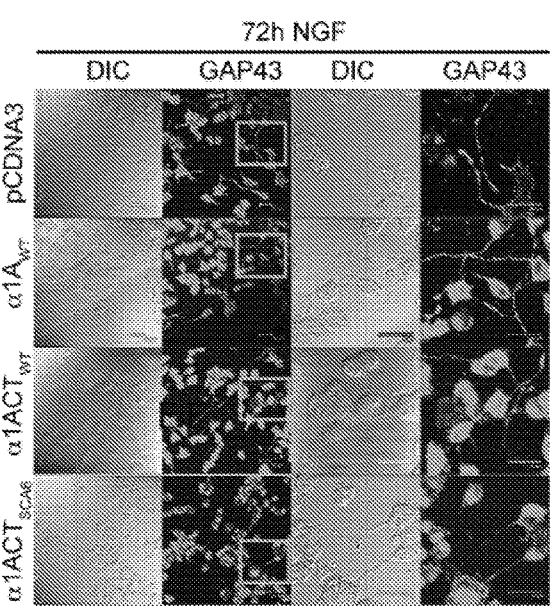
Figure 11A:
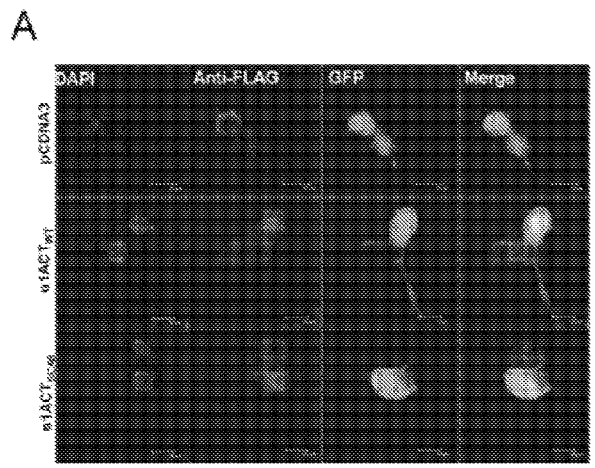
FIG. 11. α1ACT induced neurite outgrowth (related to FIG. 4) (A) Immunofluorescence of PC12 cells with transiently transfected pcDNA3-FLAG, α1ACT$_{WT}$-FLAG and α1ACT$_{SCA6}$-FLAG. Anti-FLAG staining was shown in red and nuclei were stained in blue with DAPI. The GFP protein was co-transfected to visualize PC12 cell body and neurites. The PC12 cells expressing α1ACT$_{WT}$-FLAG and α1ACT$_{SCA6}$-FLAG showed strong anti-FLAG staining (red) of nuclei (blue) and lighter staining of neurites compared with pcDNA3. (B-D) Quantitation of neurite outgrowth in transfected cells after NGF (50 ng/ml) treatment for 24 hrs, 48 hrs and 72 hrs. The number of cells with neurites, average neurite length and percentage of neurites per PC12 cell were increased in α1ACT$_{WT}$-FLAG expressing cells compared to those in cells expressing pcDNA3-FLAG and α1ACT$_{SCA6}$-FLAG at three time points (means±SEM, n=200; p<0.01 versus pcDNA3-FLAG). (E) α1ACT$_{WT}$ induced neurite outgrowth. Expression of both α1ACT$_{WT}$ and α1A$_{WT}$ induced neurite outgrowth in PC12 cells. α1A$_{WT}$-induced neurite outgrowth could not be blocked by ω-agatoxin, but was blocked by α1A$_{WT}$ specific siRNA. (F and G) Western blot showed that N-terminal sequence specific α1A$_{WT}$ siRNA could inhibit the expression of both full-length and C terminus of α1A$_{WT}$ gene in PC12 cells transfected with α1A$_{WT}$-FLAG, but did not inhibit the expression of α1ACT$_{WT}$ in PC12 cells transfected with α1ACT$_{WT}$-FLAG. (H-J) Immunofluorescence showed that N-terminal sequence specific α1A$_{WT}$ siRNA could block neurite outgrowth in PC12 cells transfected with α1A$_{WT}$-FLAG, but not in PC12 cells transfected with α1ACT$_{WT}$-FLAG after NGF treatment. (K) Quantitation of α1A$_{WT}$ induced neurite outgrowth in PC12 cells. (L) Western blot showed that siRNA inhibited BTG1 gene expression in stable cell lines expressing α1ACT$_{WT}$, α1ACT$_{SCA6}$ and pcDNA3 after siBTG1 at 0 hr, 24 hrs and 36 hrs. Scale bars represent 20 μM. Data are mean±SEM.
Figure 11B:
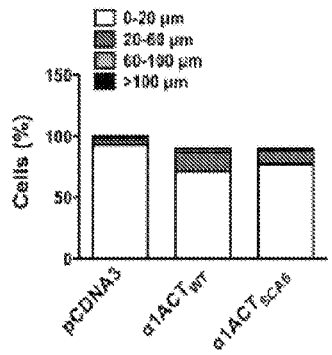
Figure 11C:
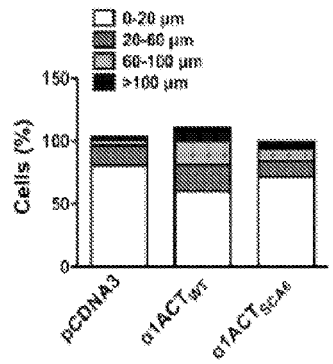
Figure 11D:
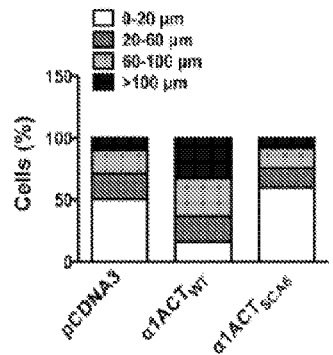
Figure 11H:
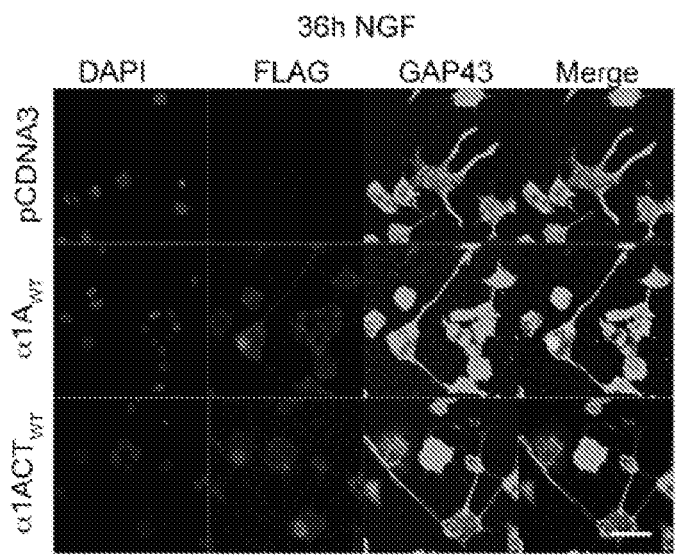
Figure 11I:
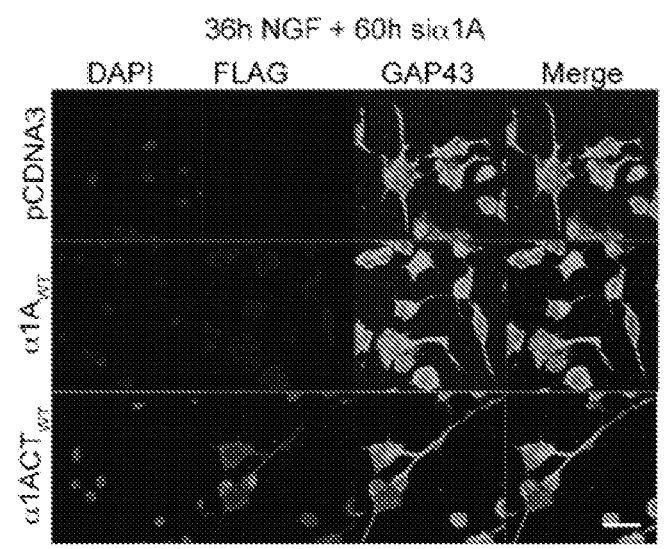
Figure 11J:
Figure 11K:
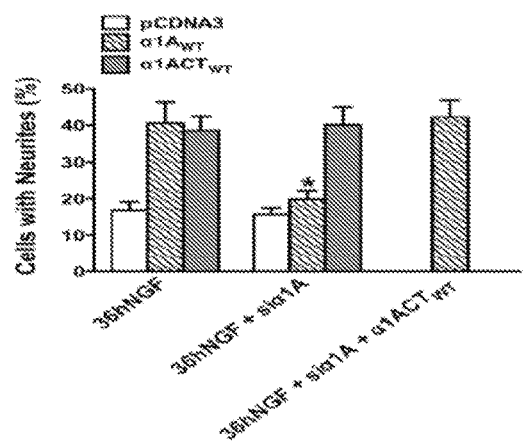
Figure 11L:
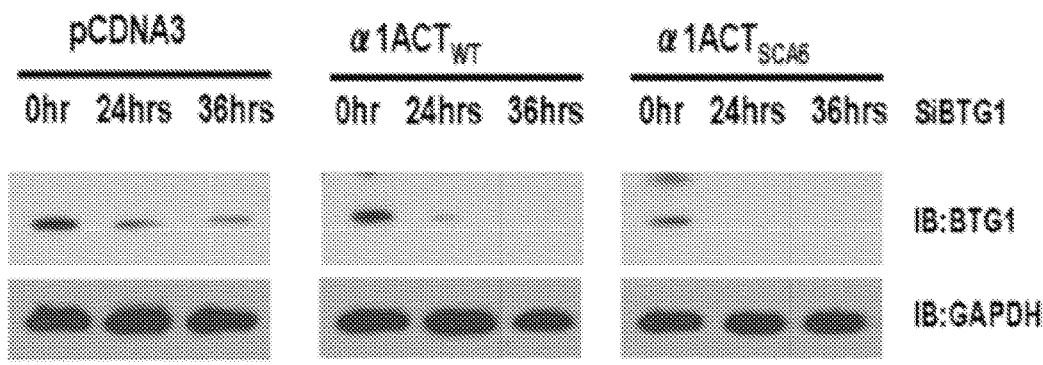
Figure 12A:
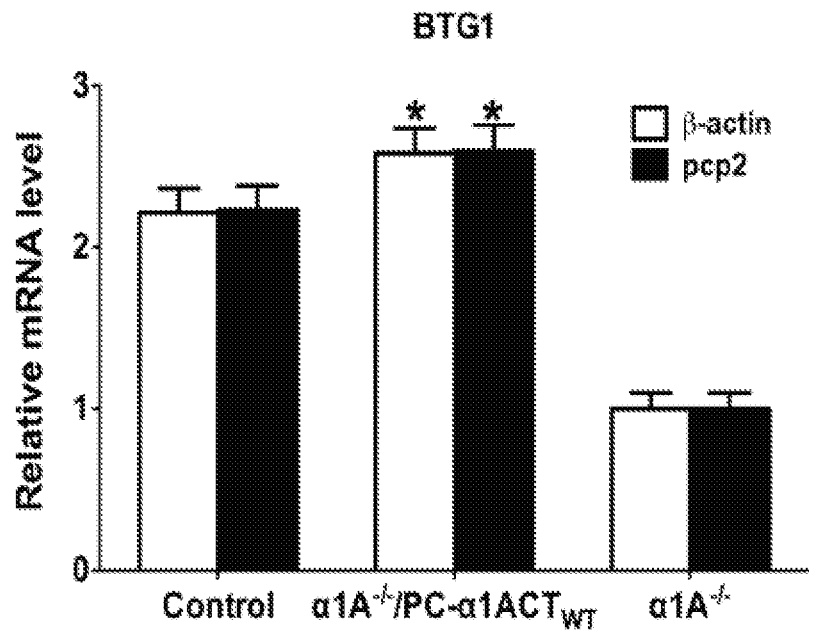
FIG. 12. Relative mRNA expression levels of BTG1, PMCA2, GRN and TAF among α1A$^{-/-}$ mice, α1A$^{-/-}$/PC-α1ACT$_{WT}$ and control mice (related to FIG. 5) (A-D) α1A$^{-/-}$/PC-α1ACT$_{WT}$ mice restored the mRNA expression of target genes (n≥3, *p<0.05). Filled bar is relative to Pcp2 gene. Open bar is relative to β-actin gene. Data are mean±SEM.
Figure 12B:
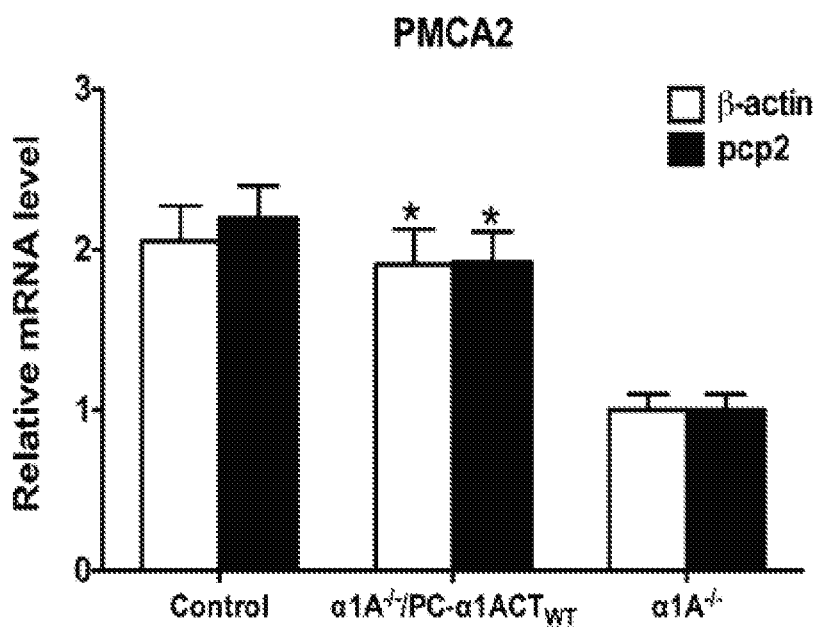
Figure 12C:
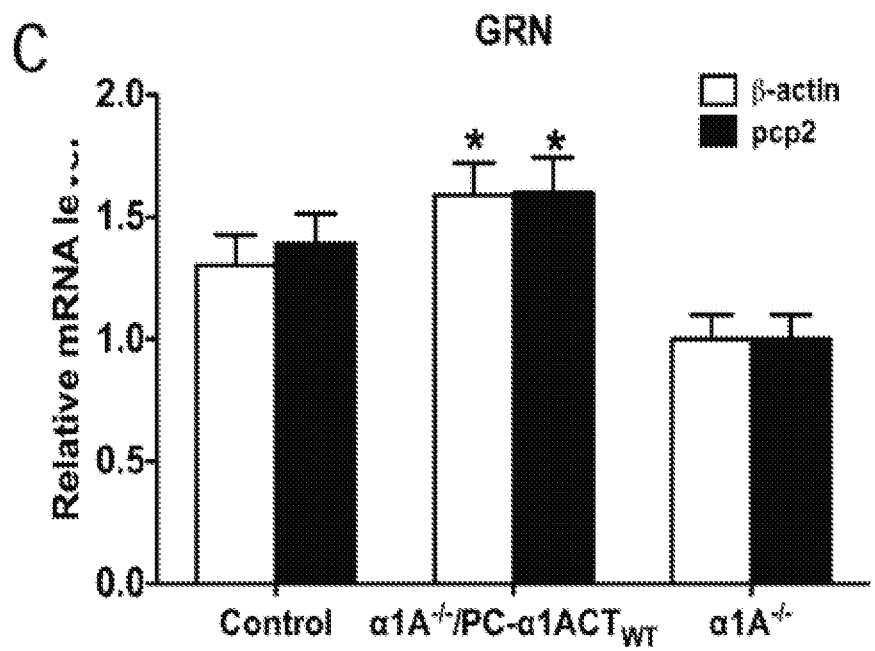
Figure 12D:
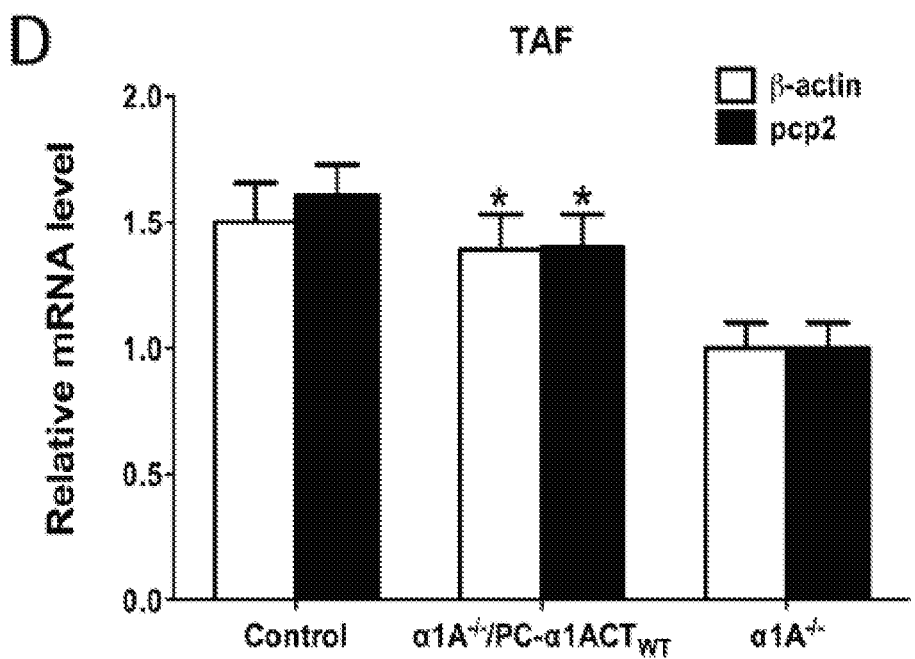

Several of the genes regulated by α1ACT are known to play a role in differentiation of the neuronal phenotype (Baker et al., 2006). We established PC12 cell lines stably expressing 3×FLAG-tagged versions of either the full-length α1A or the α1ACT fragment. Upon induction with nerve growth factor (NGF) for 24 hrs, we observed that both α1A$_{WT}$-FLAG and α1ACT$_{WT}$-FLAG enhanced neurite outgrowth (fraction of cells with neurites) when compared with PC12 cells expressing empty vector (FIG. 4E-4H and FIG. 11A-11D). Importantly, the P/Q channel blocker, ω-aga-toxin, had no effect on α1ACT$_{WT}$-induced neurite outgrowth (FIG. 11E). Furthermore, blocking the expression of endogenous or transfected full-length α1A by siRNA, had no effect on α1ACT$_{WT}$-enhanced neurite outgrowth in PC12 cells transfected with α1ACT$_{WT}$-FLAG (FIG. 11E-11K). These findings suggest that enhanced neurite outgrowth does not depend on functioning channels or the presence of the full channel protein. There was a significant increase in the percentage of cells bearing neurites in cells transfected with α1A$_{WT}$-FLAG and α1ACT$_{WT}$-FLAG compared to controls after NGF stimulation for 24, 48 and 72 hrs (FIGS. 4E, 4F and 4H). Total neurite lengths were also increased 2 fold in α1ACT$_{WT}$-expressing cells compared with controls at each time point (FIG. 4G and FIG. 11A-11D). However, cells expressing α1ACT$_{SCA6}$-FLAG had significantly lower percentage of cells with neurites and total neurite length/cell compared with cells expressing α1ACT$_{WT}$-FLAG (FIG. 4E-4H and FIG. 11A-11D). Thus, α1ACT$_{SCA6}$ lacks the normal function of α1ACT$_{WT}$ in potentiating neurite outgrowth in neuronal cells.

BTG1 belongs to the BTG/TOB protein family of antiproliferative genes. Both BTG1 and BTG2 proteins interact with the protein arginine N-methyltransferase (i.e. PRMT1) and positively modulate its activity. The PRMT1/BTG methylation pathway is involved in maintaining neuronal cells in a differentiated state (Berthet et al., 2002). We used BTG1 antibody to immunoprecipitate PRMT1 in PC12 cells stably transfected with α1ACT$_{WT}$ and α1ACT$_{SCA6}$. In α1ACT$_{WT}$-expressing cells the quantity of precipitated PRMT1 was increased, while in α1ACT$_{SCA6}$-expressing cells precipitated PRMT1 was decreased, consistent with the expression of BTG1 in these two cell types (FIG. 4I). Meanwhile, silencing of BTG1 by small interference RNA (siRNA) blocked the NGF-induced α1ACT-regulated neurite outgrowth (FIG. 4J-4L and FIG. 11L). These results demonstrate that α1ACT with normal range polyQ maintains the physiological expression of the BTG1 gene, leading to subsequent interaction of the PRMT1/BTG pathway to mediate neuronal differentiation. Together these observations suggest that the normal α1ACT acts as a transcription factor through target genes to enhance the neuronal phenotype, and that one effect of the SCA6 polyQ expansion in α1ACT is to disrupt the properties of the α1ACT transcription factor.

α1ACT Partially Rescues the Phenotype of α1A$^{-/-}$ Mice

α1A$^{-/-}$ mice, with targeted disruption of mouse CACNA1A, develop a gross neurological phenotype of seizures, dystonia, and ataxia soon after birth, and die by P18-21 (Jun et al., 1999). To investigate the importance of expression of the α1ACT fragment in PCs we used the Pcp2 promoter and Tet-off system (Zu et al., 2004) to generate two double transgenic mouse lines, Pcp2-tTA/TRE-α1ACT (abbreviated, PC-α1ACT), expressing at comparable levels either α1ACT$_{WT}$ (WT=Q4, the smallest α1ACT polyQ seen in humans) or α1ACT$_{SCA6}$ (SCA6=Q33, the largest α1ACT polyQ seen in SCA6) fragments tagged with an N-terminal myc epitope (see Methods). These mice appeared to grow and develop normally and live a full life span. α1ACT$_{SCA6}$ mice, however, had mild progressive motor problems that were evident using the treadmill (see below).

Figure 5A:
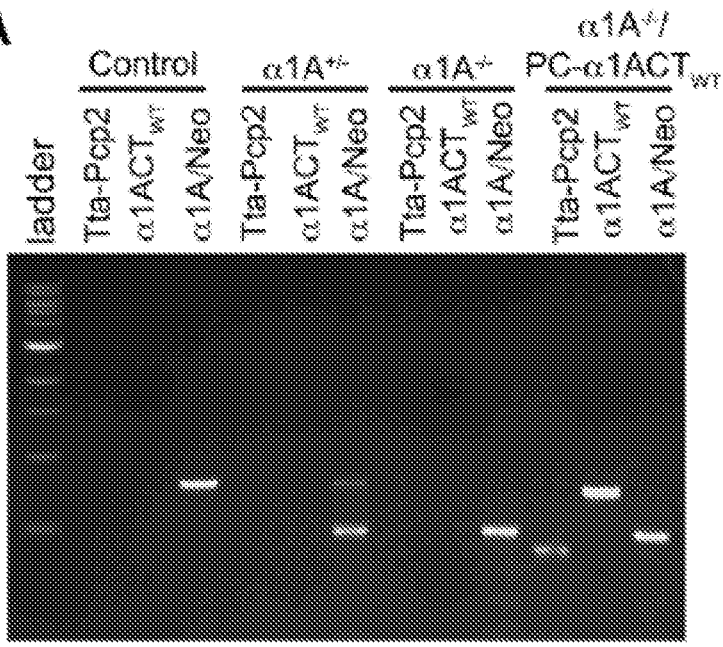
FIG. 5. α1A$^{-/-}$/PC-α1ACT$_{WT}$ transgenic mice have improved phenotype and development of cerebellar cortex compared to α1A$^{-/-}$ mice. (A and B) The genotype (A) and appearance (B) of α1A$^{-/-}$/PC-α1ACT$_{WT}$ mice. (C) α1A$^{-/-}$/PC-α1ACT$_{WT}$ mice had slightly greater body weight compared with α1A$^{-/-}$ mice at age of P14 (*p<0.05). (D) The lifespan of α1A$^{-/-}$/PC-α1ACT$_{WT}$ mice was significantly improved compared to α1A$^{-/-}$ (*p<0.05). Some pups survived until age of P30 (n=2, not included in the Figure), while all α1A$^{-/-}$ pups died before P20. (E-H) α1ACT expression improves cerebellar cortex and PC dendrites. Low power images of cerebellar ML (E). PC dendrites are labeled for calbindin-28 kDa (green). The thickness of the ML (F), the relative height of dendritic tree (G), and the density (as defined in Methods) of the PC dendritic tree (H) were reduced in α1A$^{-/-}$ mice and partially corrected in α1A$^{-/-}$/PC-α1ACT$_{WT}$ mice (100 dendritic trees from 5 mice at each group. Control is set as 1, *p<0.05). (I) Immunolabeling of PFs and PC dendrites using anti-vGlut1 (red) and anti-calbindin (green) antibodies. (J) Immunolabeling of CFs and PC dendrites using anti-vGlut2 (red) and anti-calbindin (green) antibodies. (K and L) Quantitation of CF reach (K) and relative height of dendritic tree (L) (100 CFs, *p<0.05). CF height was measured from the apical pole of PC somata to the tips of vGluT2 labeled CFs. Data are mean±SEM (see also FIG. 12).
Figure 5B:
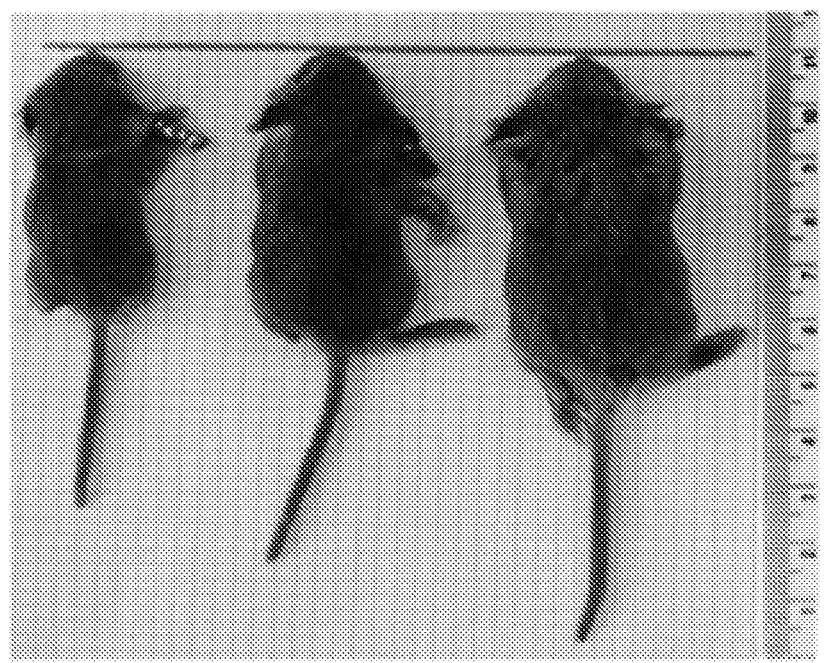
Figures 5F, 5G, 5H:
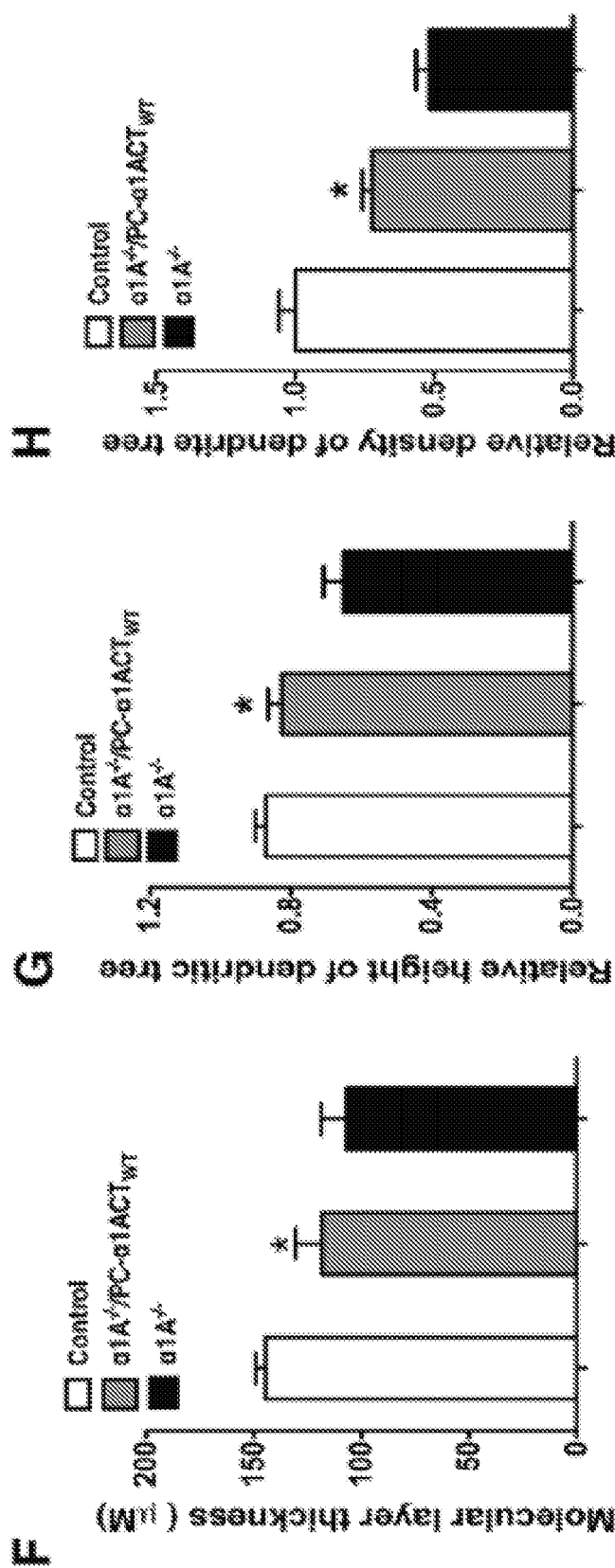
Figure 5I:
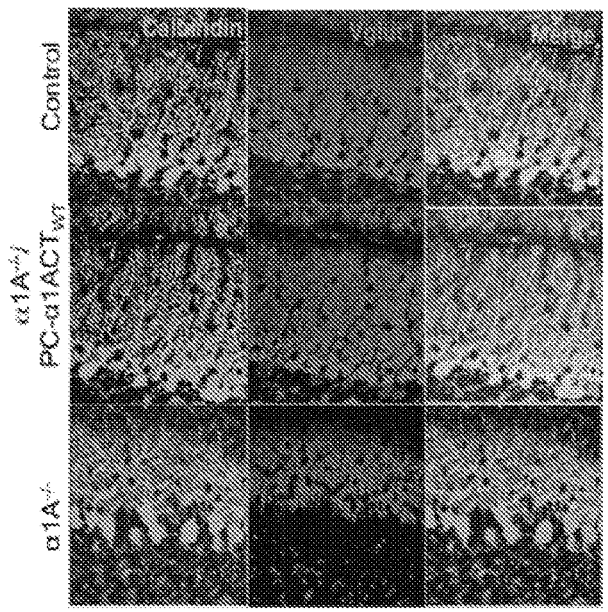
Figure 5J:
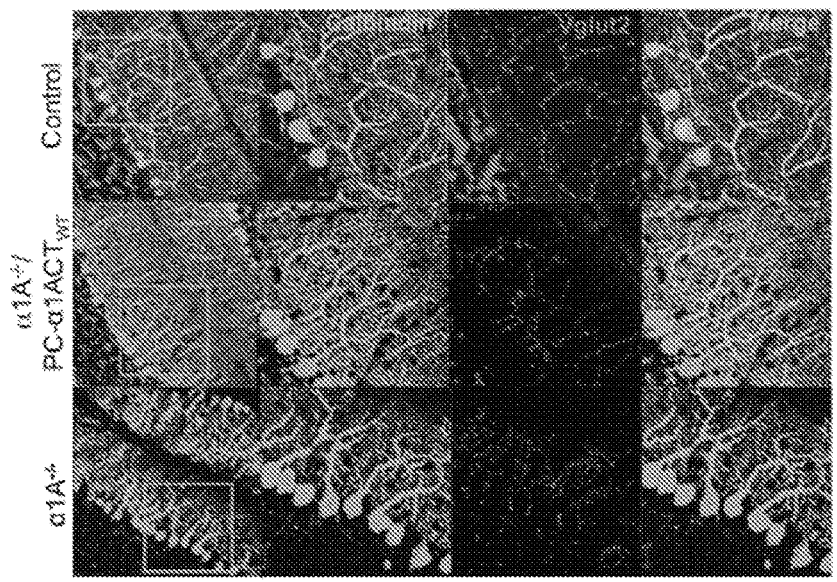
Figure 5K:
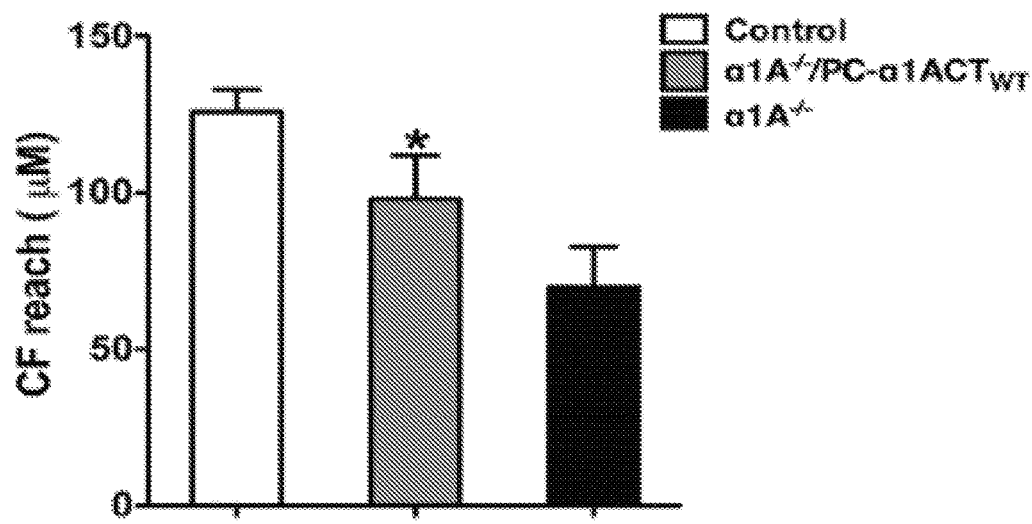
Figure 5L:
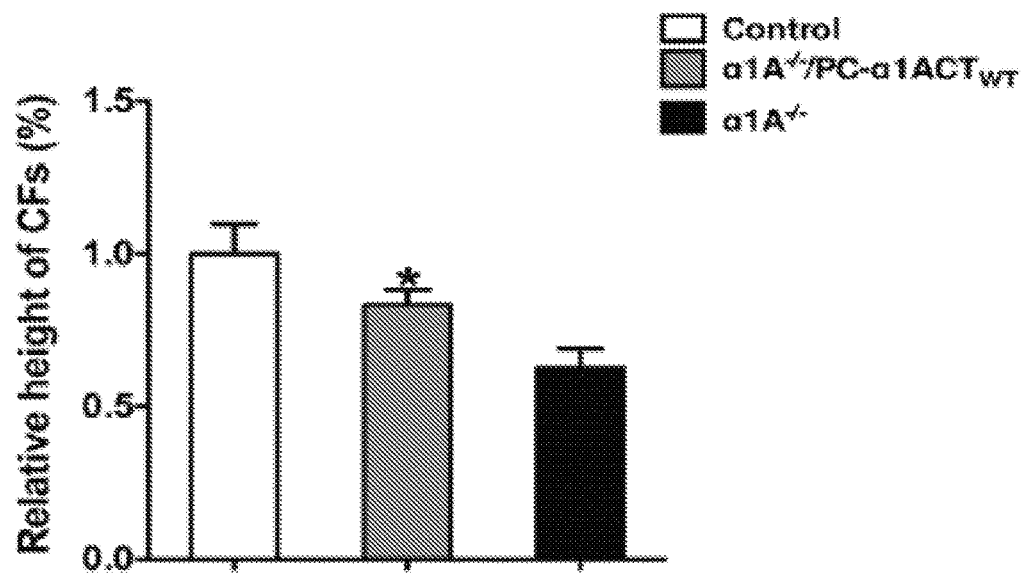

To test the role of α1ACT in cerebellar PC development in the absence of α1A channels, we bred PC-α1ACT mice with α1A$^{+/-}$ heterozygous knockout mice and subsequently crossed these offspring to generate α1A$^{-/-}$ mice with PC-targeted α1ACT expression (α1A$^{-/-}$/PC-α1ACT). Curiously we did not identify any mice with $\alpha 1A^{-/-}$/PC-$\alpha 1ACT_{SCA6}$ genotype, suggesting an impaired viability (FIG. 5A). As expected, $\alpha 1A^{-/-}$ exhibited severe neurological impairment (Jun et al., 1999). Surprisingly, $\alpha 1A^{-/-}$ mice expressing $\alpha 1ACT_{WT}$, i.e., $\alpha 1A^{-/-}$/PC-$\alpha 1ACT_{WT}$ mice, had an improved behavioral phenotype relative to $\alpha^{-/-}$ mice. Although still neurologically impaired, they gained more weight during the first two weeks of postnatal life compared to $\alpha^{-/-}$ mice (FIGS. 5B and 5C), had improved in-cage mobility (Supplementary video 1), and survived approximately 1 week longer than $\alpha 1A^{-/-}$ mice (FIG. 5D). We reasoned that the improved phenotype of $\alpha 1A^{-/-}$/PC-$\alpha 1ACT_{WT}$ mouse might be mediated through improved dendritic and synaptic development. Immunofluorescent staining of cerebellar cortex of P16 mice from three groups, WT, $\alpha 1A^{-/-}$ and $\alpha 1A^{-/-}$/PC-$\alpha 1ACT_{WT}$ mice showed that, as noted previously, PCs of $\alpha 1A^{-/-}$ mice had shortened primary dendrites with premature branching and an immature pattern of parallel fiber (PF) and climbing fiber (CF) synaptic contacts on PC soma and proximal dendrites (Hashimoto et al., 2011) (FIG. 5E-5L). In contrast, PC morphology and afferent innervation of $\alpha 1A^{-/-}$/PC-$\alpha 1ACT_{WT}$ cells resembled the pattern in WT mice (FIG. 5E-5L). In $\alpha 1A^{-/-}$/PC-$\alpha 1ACT_{WT}$ mice the thickness of molecular layer (ML), the relative height and density of the dendritic tree were significantly increased, compared to those of $\alpha 1A^{-/-}$ mice ($p<0.05$) (FIG. 5F-5H). This finding is consistent with our in vitro studies showing that $\alpha 1ACT$ enhances neurite outgrowth.

We also compared the height of CF innervation between the three mouse groups (FIG. 5J-5L) (Hashimoto and Kano, 2005; Hashimoto et al., 2011). In $\alpha 1A^{-/-}$ mice, most PCs were multi-innervated, and the CF height only reached 65.2±5.3% of the ML at P16. We found that the CF height was improved in $\alpha 1A^{-/-}$/PC-$\alpha 1ACT_{WT}$ mice over that of $\alpha 1A^{-/-}$ mice, reaching to 80.7±4.1% of the ML at P16 ($p<0.05$). However, $\alpha 1A^{-/-}$/PC-$\alpha 1ACT_{WT}$ mice exhibited the same three patterns of CF contacts seen with $\alpha 1A^{-/-}$ mice, mono CF on PC dendrites, multiple CF contacts on proximal dendrites, and multiple CF contacts on PC soma (FIG. 5). These results demonstrate that $\alpha 1ACT$, as a transcription factor, plays an important role in establishing normal dendritic tree morphology in PCs in vivo, but that synapse elimination or selection of dominant innervation requires either P/Q channel function or $\alpha 1ACT$ under its endogenous expression pattern.

Finally, we examined mRNA levels of TAF, BTG1, PMCA2 and GRN in the three mouse groups. FIG. 12 demonstrates that the expression of these genes was decreased in cerebellar tissue of $\alpha 1A^{-/-}$ mice when compared to normal mice, but was increased 1.5 to 3 fold in $\alpha 1A^{-/-}$/PC-$\alpha 1ACT_{WT}$ transgenic mice when compared to $\alpha 1A^{-/-}$ mice ($p<0.05$), relative to either β-actin or Pcp2 gene expression (FIG. 12A-12D). These results indicate that expression of the $\alpha 1ACT$ target genes is impaired in $\alpha 1A^{-/-}$ mice and is corrected by localized expression of $\alpha 1ACT_{WT}$ in PCs of transgenic mice.

Figure 6A:
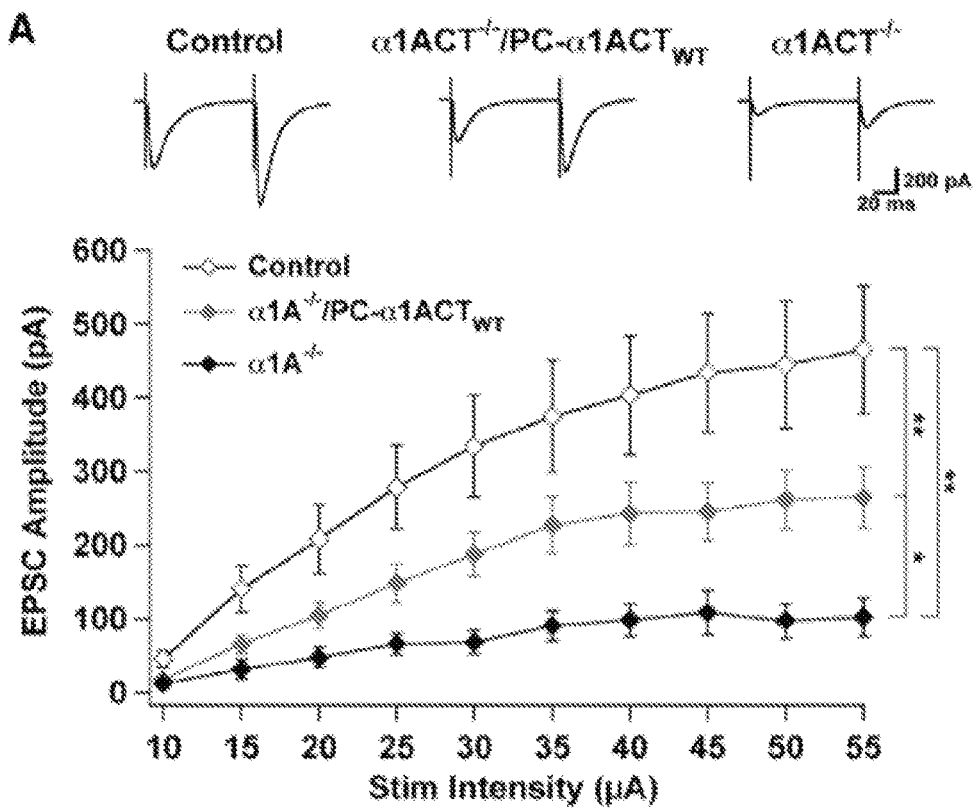
FIG. 6. α1ACT partially restores PF EPSC amplitude but does not affect CF innervation or EPSC properties. (A) PF-EPSC amplitude as a function of stimulus intensity for α1A$^{-/-}$ (n=9, N=4), α1A$^{-/-}$/PC-α1ACT (n=16, N=6), and WT (n=11, N=3) mice. Top: Typical PF-EPSCs at a stimulus intensity of 45 µA. (B) Paired-pulse ratios as a function of stimulus interval in α1A$^{-/-}$, α1A$^{-/-}$/PC-α1ACT, and WT mice. Inset shows an overlay of representative traces from all three groups of mice with an interstimulus interval of 20 ms. EPSC1 from α1A$^{-/-}$/PC-α1ACT and WT mice were scaled to match the amplitude of EPSC1 from the α1A$^{-/-}$ mouse to facilitate comparison. (C) Top: Representative CF-EPSCs elicited while holding at −30 mV. Bottom left: CF-EPSC amplitudes for α1A$^{-/-}$ (n=10, N=3), α1A$^{-/-}$/PC-α1ACT (n=11, N=3), and WT (n=8, N=3) mice. Bottom right: Paired-pulse depression of CF-EPSCs with 200 ms stimulus interval. (D) Left: representative traces from PCs in α1A$^{-/-}$ and α1A$^{-/-}$/PC-α1ACT mice exhibiting multiple CF innervation. Right: Percentage of PCs exhibiting either one, two, or three discrete CF steps in α1A$^{-/-}$ (2 steps: 6/13, 3 steps: 1/13, N=3), α1A$^{-/-}$/PC-α1ACT (2 steps: 5/13, N=3), and WT (2 Steps: 1/9, N=3) mice. All mice were age P16-18. *p<0.05, **p<0.01. Data are mean±SEM.

$\alpha 1ACT$ Partially Restores Parallel Fiber EPSC Amplitude but Not Climbing Fiber Mono-Innervation To further assess the effect of $\alpha 1ACT$ expression on Purkinje cell synaptic properties, we measured PF excitatory postsynaptic current (PF EPSC) amplitude as a function of stimulus intensity in WT, $\alpha 1A^{-/-}$, and $\alpha 1A^{-/-}$/PC-$\alpha 1ACT_{WT}$ mice (P16-18) in cerebellar slice preparations. While PF EPSCs from WT were significantly larger than those from both $\alpha 1A^{-/-}$ ($p<0.01$, stimulus intensities 20-55 µA) and $\alpha 1A^{-/-}$/PC-$\alpha 1ACT_{WT}$ mice ($p<0.05$), EPSCs from $\alpha 1A^{-/-}$/PC-$\alpha 1ACT_{WT}$ mice were greater than those from $\alpha 1A^{-/-}$ mice ($p<0.05$), indicating that $\alpha 1ACT$ expression improves PF synaptic connections (FIG. 6A).

Figure 6B:
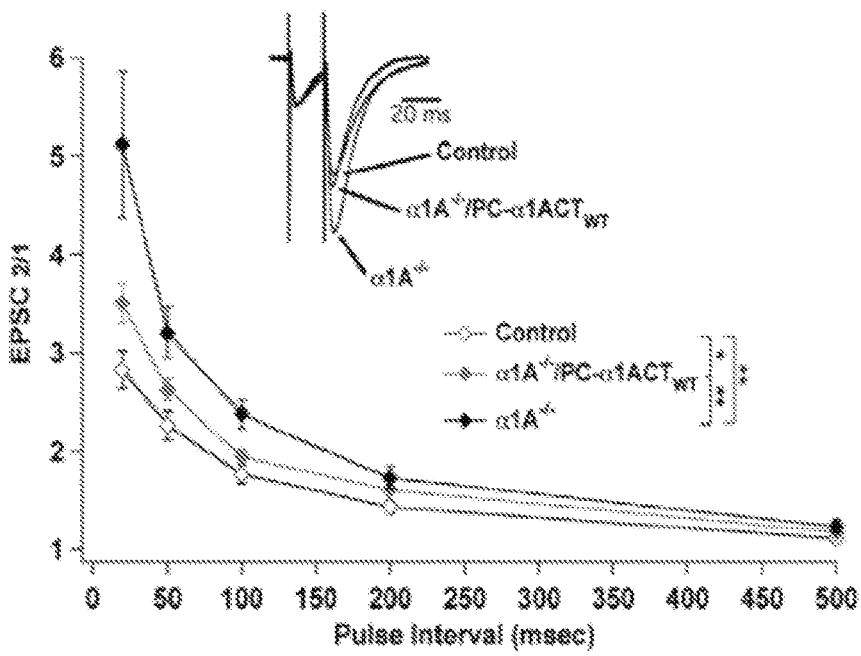

The inability of $\alpha 1ACT$ to completely restore EPSC amplitudes to WT levels could be explained by the absence of P/Q-type $Ca^{2+}$ channels in PF presynaptic terminals of $\alpha 1A^{-/-}$/PC-$\alpha 1ACT_{WT}$ mice, as these channels play a critical role in neurotransmitter release at PF-Purkinje cell (PF-PC) synapses (Matsushita et al., 2002; Mintz et al., 1995). We therefore examined the presynaptic release properties of PF-PC synapses in $\alpha 1A^{-/-}$ and $\alpha 1A^{-/-}$/PC-$\alpha 1ACT_{WT}$ mice by measuring the paired-pulse ratios (PPRs) of PF EPSCs. Large PPRs are indicative of low initial release probabilities, and are a sign of impaired presynaptic function (Zucker and Regehr, 2002). In accordance with observations from mouse models harboring loss-of-function mutations in the CACNA1A gene, $\alpha 1A^{-/-}$ mice exhibited PPRs significantly greater than WT at several stimulus intervals (WT to $\alpha 1A^{-/-}$ mice: $p<0.01$ for stimulus intervals of 20-100 ms, FIG. 6B) (Liu and Friel, 2008; Matsushita et al., 2002). While $\alpha 1ACT$ expression did lower PPRs closer to WT levels ($\alpha 1A^{-/-}$/PC-$\alpha 1ACT_{WT}$ to $\alpha 1A^{-/-}$ mice: $p<0.01$ for stimulus intervals of 20 and 100 ms, $p<0.05$ for stimulus interval of 50 ms), the measured values were still elevated (WT to $\alpha 1A^{-/-}$/PC-$\alpha 1ACT_{WT}$: $p<0.05$ for stimulus intervals of 20 and 50 ms) (FIG. 6B), suggesting a residual presynaptic deficit.

Figure 6C:
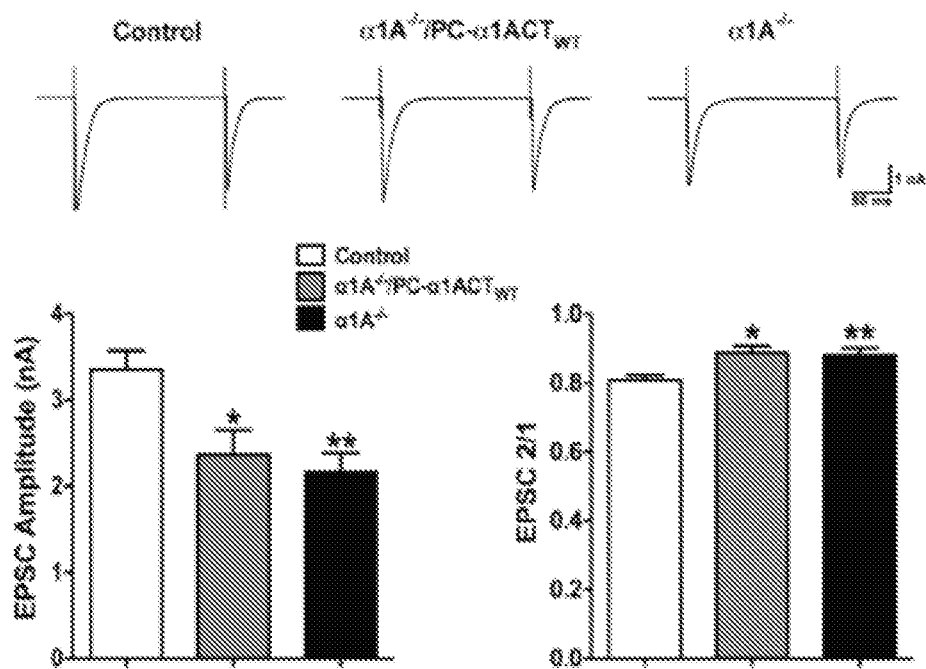
Figure 6D:
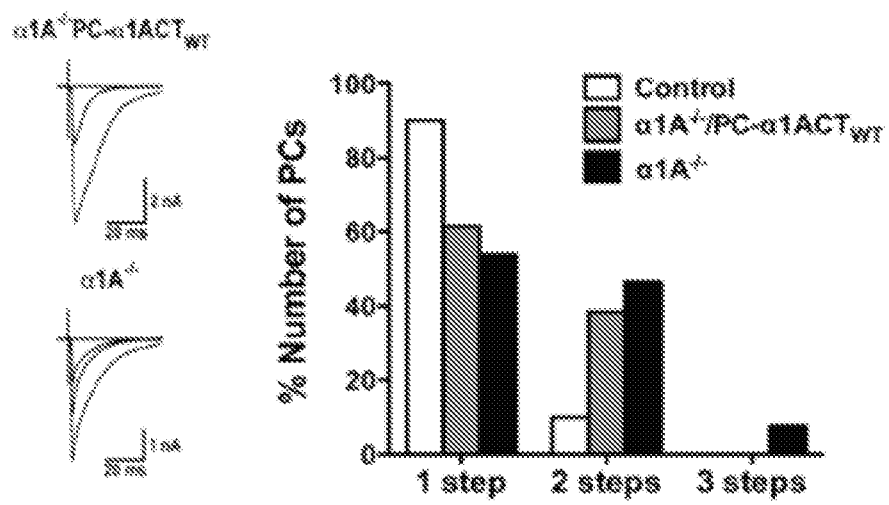

We also examined properties of the CF synapse onto Purkinje cells. We observed a reduction in CF EPSC amplitudes and a decrease in the degree of paired-pulse depression in both $\alpha 1A^{-/-}$ and $\alpha 1A^{-/-}$/PC-$\alpha 1ACT_{WT}$ mice with respect to WT, both of which could also be due to the absence of P/Q-type channels presynaptically (FIG. 6C). Additionally, we investigated whether ccIACT expression affects the process of CF maturation. During development, Purkinje cells undergo a competitive and activity-dependent elimination of superfluous CF inputs until only one remains. Impairments to this process results in the persistent innervation of Purkinje cells by multiple climbing fibers into adulthood. We found the proportion of Purkinje cells with multiple CF innervations to be increased in both $\alpha 1A^{-/-}$ and $\alpha 1A^{-/-}$/PC-$\alpha 1ACT_{WT}$ mice compared to WT, a result indicating that actual P/Q-type $Ca^{2+}$ channel function, and not just expression of the C terminus, may be essential for proper CF maturation (Watanabe and Kano, 2011) (FIG. 6D). Our results provide evidence that $\alpha 1ACT$ expression improves the synaptic connections of PFs, but not CFs, onto Purkinje cells.

Figure 7D:
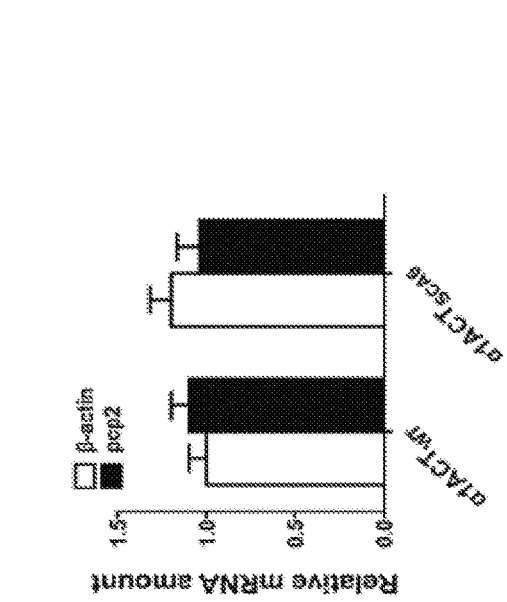
FIG. 7. α1ACT$_{SCM}$ is a pathogenic fragment. (A) Representative fluorescence dot blots of FITC-Annexin V and propidium iodide (PI) stained PC12 cells with stably-transfected pcDNA3-FLAG, α1ACT$_{WT}$-FLAG and α1ACT$_{SCA6}$-FLAG. (B and C) Quantitation of Annexin V and PI positive cells (*p<0.05). (D) Cell death as measured by LDH release assay (*p<0.05). (E) Expression levels of α1ACT$_{WT}$ and α1ACT$_{SCM}$ in cerebellar homogenates by qRT-PCR. (F) Double support of Hind paw was impaired in PC-α1ACT$_{SCA6}$ transgenic mice compared with PC-α1ACT$_{WT}$ transgenic mice at age 3-month, 9-month old (*p<0.01). (G and H) Cerebellar cortical atrophy in PC-α1ACT$_{SCM}$ transgenic mice. Low power images of cerebellar ML in mice at ages of 20-26 months (G) and Quantitation of ML thickness (H) (*p<0.05). PCs dendrites are labeled for calbindin (green). (I) Schematic illustration of expression regulation and function of α1ACT. Data are mean±SEM (see also FIG. 13).

$\alpha 1ACT_{SCA6}$ Causes Cell Death in vitro and Mediates Ataxia and Cerebellar Cortical Atrophy in Transgenic Mice Previous studies have shown that the $\alpha 1A$ C terminus bearing an expanded polyQ tract is toxic relative to WT $\alpha 1A$ C terminus when transiently over-expressed in cultured mammalian cells (Ishiguro et al., 2010; Kubodera et al., 2003). Our flow cytometry results showed that PC12 cells stably expressing $\alpha 1ACT_{WT}$ exhibited equivalent viability to vector control cells, while cells expressing $\alpha 1ACT_{SCA6}$ had approximately a 2-fold increase in cell death ($p<0.05$, FIG. 7A-7C) (Koopman et al., 1994). Also, LDH release was significantly higher in cells expressing the $\alpha 1ACT_{SCA6}$ compared with that of PC12 cells expressing only pcDNA3 or $\alpha 1ACT_{WT}$ (FIG. 7D). These findings indicate that over-expression of $\alpha 1ACT$ bearing pathological size of polyQ reduces cell viability in cultured mammalian cells.

Figure 7E:
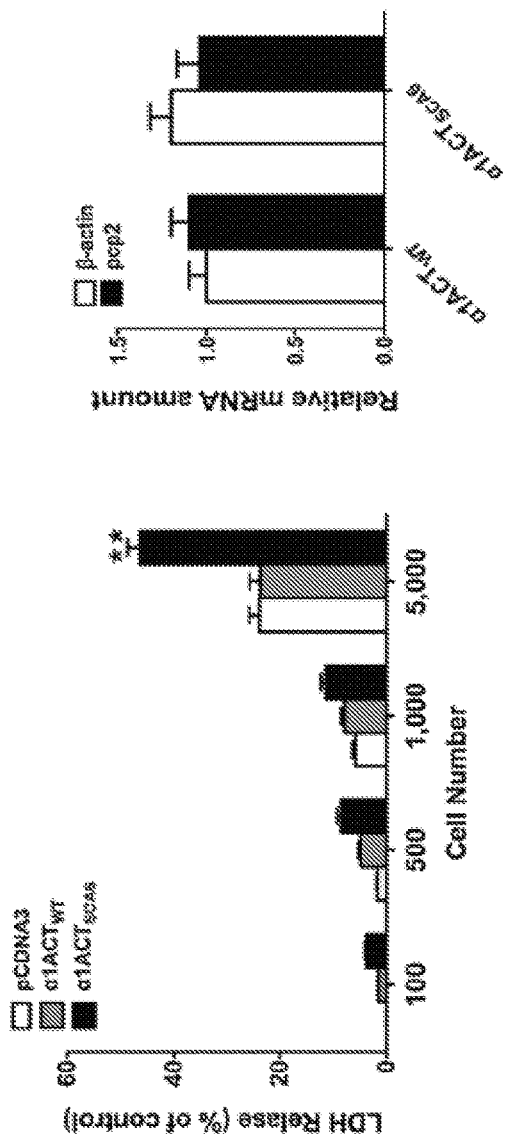
Figure 7H:
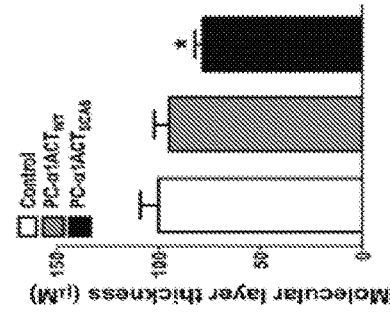
Figure 7G:
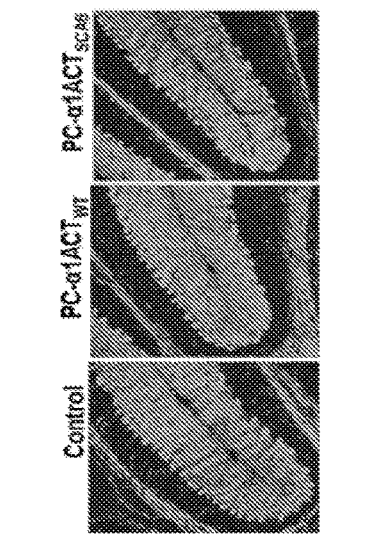
Figure 7F:
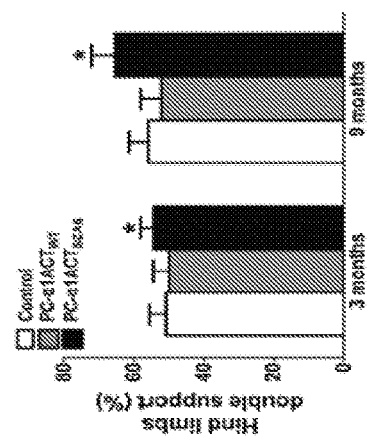
Figure 13A:
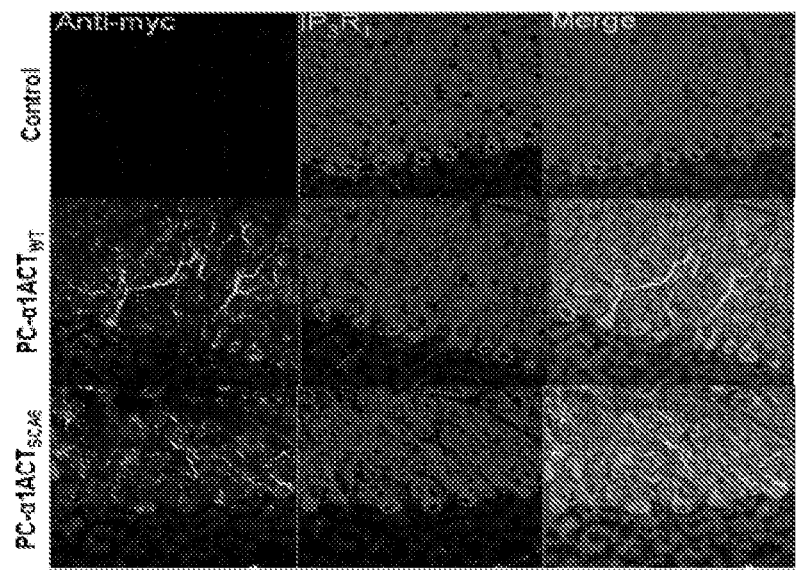
FIG. 13. Generation of transgenic mice over-expressing α1ACT fragment with pathological polyQ (related to FIG. 7) (A) Immunostaining of myc-labeled α1ACT fragments carrying normal and pathological ranges of polyQ in mouse cerebellum. The anti-myc antibody was labeled in green. Purkinje cells were labeled using antibody to type 1 inositol 1,4,5-triphosphate receptors (IP$_3$R$_1$ in red) which, unlike calbindin, does not label the nucleus. (B) Expression levels of α1ACTWT and α1ACTSCA6 in cerebellar homogenates by Western blot with anti-Myc antibody (C-F) Relative mRNA expression level of BTG1, PMCA2, GRN and TAF among control and PC-α1ACT$_{SCA6}$ transgenic mice. Expression of BTG1 and PMCA2 was decreased 30%-40%, and expression of TAF and GRN was decreased 10%-15% in PC-α1ACT$_{SCA6}$ transgenic mice compared with those in control mice (n≥3, *p<0.05). Filled bar is relative to Pcp2 gene. Open bar is relative to β-actin gene. Data are mean±SEM.
Figure 13B:
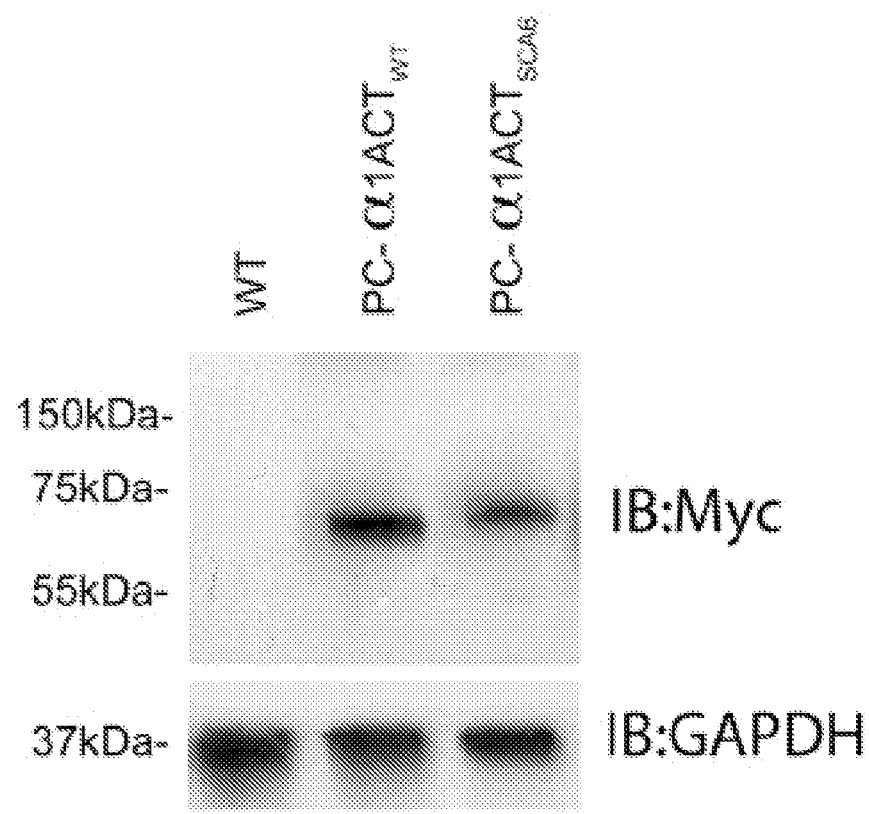
Figure 13C:
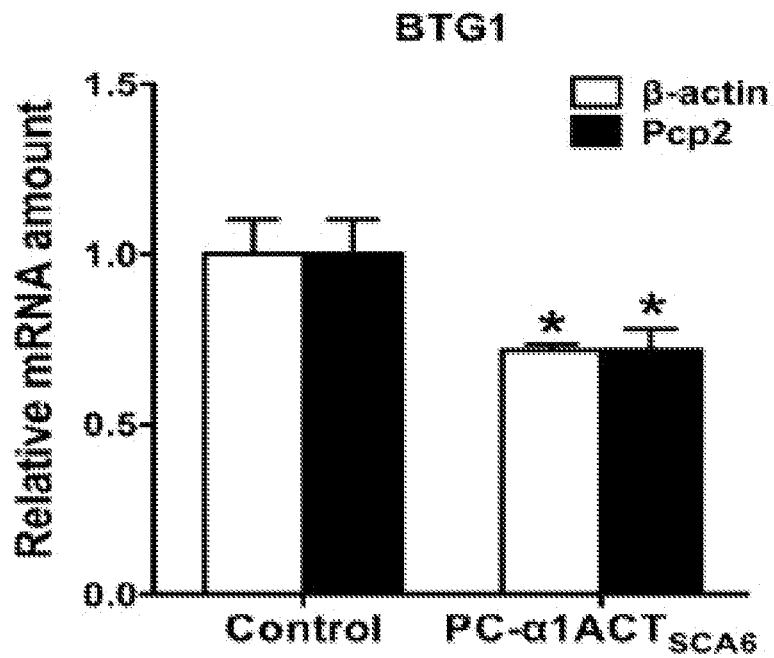
Figure 13D:
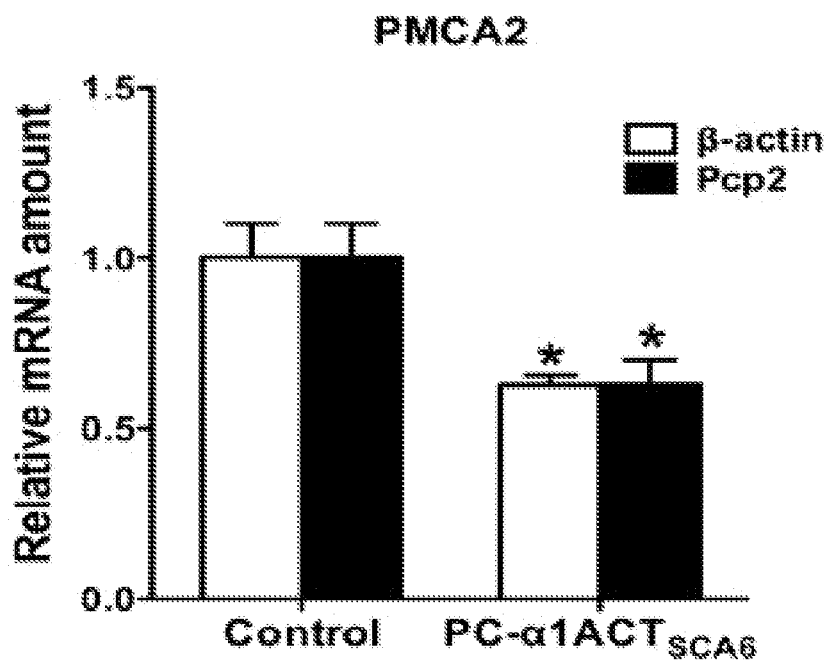
Figure 13E:
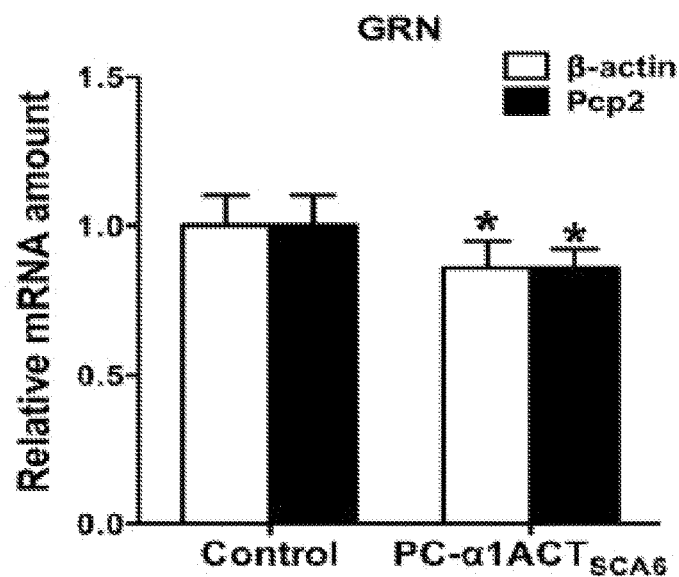
Figure 13F:
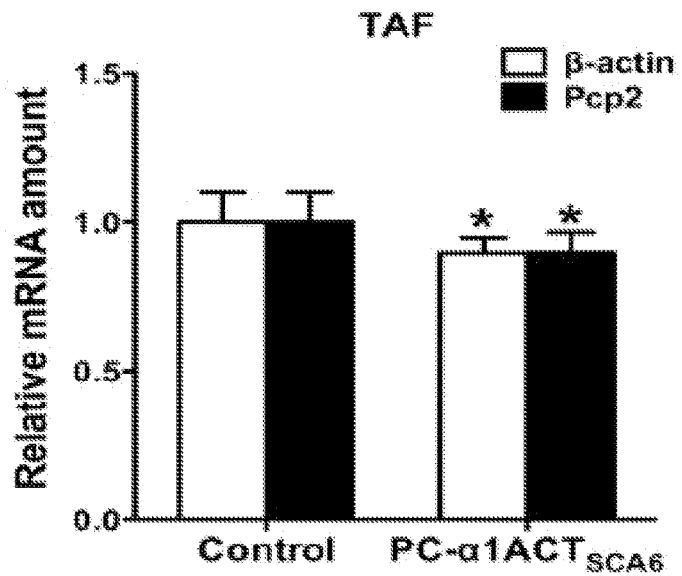

Finally, we tested whether over-expression of the SCA6-expanded $\alpha 1ACT_{SCA6}$ fragment in mice would lead to clinical or pathological features resembling SCA6, compared with over-expression of the fragment with normal allele size, α1ACT$_{WT}$. Both α1ACT$_{WT}$ and α1ACT$_{SCA6}$ can be detected in the nucleus of PCs in the corresponding PC-α1ACT lines at comparable levels by western blot, RT-PCR and immunostaining (FIG. 7E, FIG. 13A and FIG. 13B). There were no obvious clinical differences between these two lines in young adults, and lifespan was not affected. However, we found that PC-α1ACT$_{SCA6}$ mice demonstrated significant abnormalities in several gait parameters compared with PC-α1ACT$_{WT}$ mice using a video-assisted computerized treadmill for gait analysis (DigiGait, Mouse Specifics, Inc) ($p<0.05$, after post hoc correction). Most importantly, they exhibited an age-dependent increase in shared stance (double support time) of hind limbs, between ages 3 and 9 months, indicating progressive instability during walking ($p<0.05$, FIG. 7F and Supplementary video 2 and 3) (Matsukawa et al., 2003; Stolze et al., 2002). The gait disturbance never progressed to the level of severe ataxia, although natural changes in weight gain in older mice may have obscured an impact on normal cage activity. The lack of severe ataxia even in 2-year-old mice is not surprising for a model of SCA6, with an age of onset of 43-52 years. Although we found no obvious sign of cell loss in the cerebellum in α1ACT$_{SCA6}$ mice at approximately 2 years of age, measurement of the ML thickness showed that α1ACT$_{SCA6}$-expressing mice have significant thinning of the ML, compared with age-matched α1ACT$_{WT}$ and WT mice (FIGS. 7G and 7H). Lastly, using RT-PCR to examine the expression levels of ChIP-identified genes TAF, GRN, BTG1 and PMCA2 in cerebellar tissues of 2-year-old PC-α1ACT$_{SCA6}$ mice compared with age-matched WT mice, we found that the transcript levels of each of the α1ACT-regulated genes were decreased by between 11% and 34% (FIG. 13C-6F). These findings are the first to demonstrate clinical and pathological changes in an animal model of SCA6 expressing appropriate-sized pathological alleles within a CACNA1A protein.

CACNA1A Contains a Cellular IRES

Cellular IRES s play an increasingly recognized role in the control of eukaryote gene expression where in many 5' UTRs they provide alternatives to cap-dependent translation initiation during times of cellular stress (Coldwell et al., 2001; Spriggs et al., 2008). IRES sequences have also been detected within the coding regions of some cellular mRNAs, leading to the expression of isoforms or distinct protein products (Cornelis et al., 2000; Ul-Hussain et al., 2008). Together with the present report, these observations suggest that expression of bi-functional genes, particularly those encoding separate transcription factor proteins in the second cistron, may be a newly-recognized strategy for coordinating gene expression programs tied to individual gene products. This could enable the timely expression of a set of genes coincident with the appearance of key proteins during differentiation.

α1ACT, a CACNA1A-Encoded Transcription Factor Promotes a Neurite Outgrowth Program As a transcription factor, the normal α1ACT enhances the expression of at least three genes, GRN, PMCA2 and BTG1, in PC12 cells and cerebellar tissue, potentiates NGF-mediated neurite outgrowth in PC12 cells, and partially rescues the CACNA1A knockout phenotype. GRN is involved in neurite outgrowth and is critical in maintaining neuronal survival, since loss-of-function mutations of the GRN gene lead to cell death in the frontal and temporal lobes (Baker et al., 2006; Cruts et al., 2006; Van Damme et al., 2008). PMCA2 is highly expressed in the cerebellum, particularly in PCs and throughout the ML and granule cell layer (Zacharias and Kappen, 1999). PMCA2 knock-out mice exhibit vestibular and gait abnormalities and reduced thickness of the cerebellar ML (Kozel et al., 1998). Lack of PMCA2 also dramatically alters PC morphology. PMCA2 is a component of mGluR1-IP3R1 signaling complex, which has been implicated in plasticity at the PF-PC synapse (Kurnellas et al., 2007).

The PRMT1/BTG methylation pathway is involved in neurogenesis or in maintaining neuronal cells in a differentiated state. The 3' UTR of BTG1 is highly conserved throughout evolution and plays a key role in this pathway (Rouault et al., 1993), consistent with our finding that α1ACT activates a novel 3' enhancer element of BTG1. Enhanced BTG1/PRMT1-driven arginine methylation partly accounts for the essential role of protein methylation during PC12 differentiation (Cimato et al., 1997), which is in line with findings here that BTG1 knockdown blocks neurite outgrowth. Together these findings suggest that α1ACT$_{WT}$ is essential for maintenance of neurite outgrowth through gene-specific signaling pathways. It will be of interest to extend our ChIP-based cloning approach using RNA-seq methodology to more completely characterize the normal repertoire of α1ACT-regulated genes, as well as those bound by α1ACT$_{SCA6}$.

Except for the in vivo studies, the properties of α1ACT are similar to those demonstrated for the 70 kD fragment, termed CCAT, derived from the Cav1.2 channel, α1C subunit, which may arise from a similar translational mechanism (Gomez-Ospina et al., 2006). In that case, as well as in ours, the set of genes regulated by these novel transcription factors does not conform to an obvious functional class of proteins, but appears to be involved in elaborating key components of the neuronal phenotype, and in neurogenesis or neurodegeneration, timed with the appearance of Ca$^{2+}$ channel activity.

Phenotype Rescue of α1A$^{-/-}$ Mice by α1ACT

The improved phenotype at behavioral, histological, and electrophysiological levels in α1A$^{-/-}$/PC-α1ACT$_{WT}$ mice is remarkable, particularly because α1ACT$_{WT}$ expression, under the control of PC specific promoter, Pcp2, was only restored in PCs. Consistent with these findings and our in vitro results, ChIP-identified genes TAF, BTG1, PMCA2 and GRN were down-regulated in α1A$^{-/-}$ mice, but were increased 1.5 to 3 fold in α1A$^{-/-}$/PC-α1ACT$_{WT}$ transgenic mice. These results suggest that α1ACT, as a second gene product from CACNA1A, plays an important role in establishing normal morphology and function of PCs.

α1ACT Expression Improves PF-PC Connections

PF EPSC amplitudes measured in α1A$^{-/-}$/PC-α1ACT$_{WT}$ were significantly greater than those observed in α1A$^{-/-}$ mice, though they were not completely restored to WT levels, presumably due to the importance of P/Q-type Ca$^{2+}$ channel function to neurotransmitter release at PF-PC synapses (Mintz et al., 1995). α1ACT expression also resulted in a partial reduction of PPRs at this synapse, which was surprising as PPRs generally reflect presynaptic release probabilities, and α1ACT is present only postsynaptically in α1A$^{-/-}$/PC-α1ACT$_{WT}$ mice, indicating that factors either directly or indirectly related to the postsynaptic target cell can also influence this parameter. Regardless, the residual elevation of PPRs in α1A$^{-/-}$/PC-α1ACT$_{WT}$ mice suggests that the incomplete restoration of PF EPSC amplitude is due to a presynaptic deficit in these mice.

The absence of any discernable effect of α1ACT expression on CF-EPSCs indicates that actual P/Q-type Ca$^{2+}$ channel function is required for the process of CF maturation, as has been suggested previously (Watanabe and Kano, 2011). Thus, it appears that the phenotypic benefits of α1ACT expression are due predominantly to the improvement in PF synaptic transmission.

α1ACT$_{SCA6}$ Abolishes the Normal Function of α1ACT in Gene Expression Regulation and is Pathogenic in vitro and in vivo Compared the properties of the normal α1ACT protein, α1ACT$_{WT}$, bearing 4 or 11 glutamines, the α1ACT$_{SCA6}$ polypeptide had altered binding to the BTG1 enhancer, showing additional DNA-protein complexes, and lacked the capacity to mediate expression via BTG1 and GRN luciferase reporters and impaired expression of these genes in PC12 cells. α1ACT$_{SCA6}$ also failed to mediate neurite outgrowth when stably expressed in PC12 cells and caused increased cell death. This may explain why we did not obtain any mice with α1A$^{-/-}$/PC-α1ACT$_{SCA6}$ genotype. Mice over-expressing α1ACT$_{SCA6}$ on a normal background exhibited subtle, but clearly measurable defects in motor functioning. Computerized treadmill gait analysis demonstrated progressive gait impairment with an increase in double limb support, a compensatory reaction to instability during walking. With advanced age α1ACT$_{SCA6}$ was associated with thinning of the cerebellar cortex. These mice have reduced levels of expression of TAF1, GRN, BTG1 and PMCA2, the targets of α1ACT, relative to endogenous PC transcripts. These studies suggest that, rather than arising from ion channel dysfunction, the pathogenesis of SCA6 more closely resembles the toxic gain-of-function mechanism of the polyQ disorders (La Spada et al., 1991; Palhan et al., 2005; Sopher et al., 2004). This is supported by the lack of disturbed Ca$^{2+}$ channel function in two mouse knockin studies of the SCA6 mutation (Saegusa et al., 2007; Watase et al., 2008). If additional studies further support this Ca$^{2+}$ channel-independent mechanism, the demonstration of selective translation based on an IRES may pave the way for therapies targeted at suppressing the IRES function.

Figure 7I:
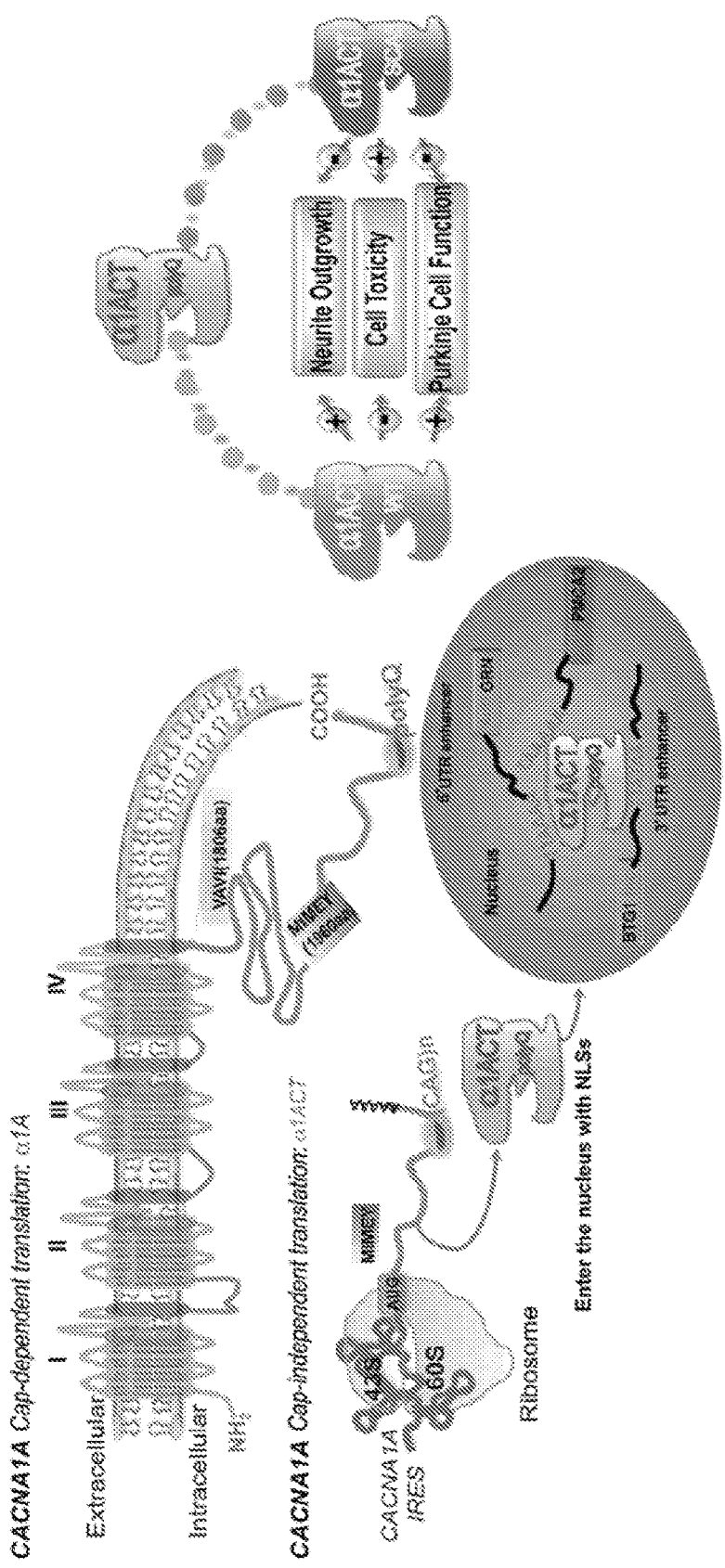

We have shown that the CACNA1A gene is bi-cistronic, encoding a newly identified transcription factor, α1ACT, involved with neurite outgrowth and PC maturation, within the cc1A mRNA. α1ACT also bears the expanded polyQ tract in SCA6, which interrupts transcription factor function, impairs viability of cultured cells and is pathogenic in transgenic mice. These findings are summarized in the diagram in FIG. 7I.

Example 3

Additional studies were carried out as described below. Also provided below is a description of an exemplary method of identifying a compound with SCA6 therapeutic activity. It is described as a Renilla luciferase/Firefly luciferase (R-Luc/F-Luc) bicistronic reporter assay.

Spinocerebellar ataxia type 6 (SCA6) is a dominantly inherited neurodegenerative disease characterized by progressive ataxia and Purkinje cell degeneration, associated with CAG repeat expansions in the gene, CACNA1A. No preventive treatment exists for the numerous polyglutamine (polyQ) diseases including SCA6. Although CACNA1A is known to encode the α1A subunit of the neuronal P/Q-type voltage-gated Ca$^{2+}$ channel, numerous efforts have failed to implicate expanded polyQ tracts and altered P/Q channel function in SCA6. However, our recent evidence indicates that the disease is attributable to expression of a polyQ repeat expansion within a second CACNA1A gene product, α1ACT, that normally serves as a transcription factor (TF) critical for cerebellar cortical development. SCA6-sized polyQ expansions in the α1ACT transcription factor interrupt its cellular and molecular function, and the toxicity of α1ACT with SCA6-sized polyQ expansions has been shown in cellular models and in vivo, as disclosed herein.

We recently discovered that α1ACT arises from a gene regulatory mechanism that is novel for the CACNA1A gene and for ion channel genes in general, in which expression of α1ACT is under the control of a cryptic cellular internal ribosomal entry site (IRES) within the CACNA1A gene coding region. We expect the cellular IRES-regulated α1ACT to be required for Purkinje cell development, and that the polyQ-expanded variant, α1ACT$_{SCA6}$, leads to neurodegeneration. The working examples disclosed herein establish that α1ACT$_{SCA6}$ alters gene expression in a manner expected to contribute to the pathogenesis of SCA6. The disclosures herein also provide a screening strategy for potential IRES-inhibiting compounds as potential therapies.

Spinocerebellar Ataxias

Spinocerebellar ataxia type 6 (SCA6), a form of spinocerebellar ataxia (SCA), is a dominantly inherited neurodegenerative disease characterized by progressive ataxia and Purkinje cell degeneration, associated with CAG repeat expansions in the gene, CACNA1A. SCA6 is a severe neurological disorder, and one of the most common SCAs worldwide (1-6), roughly as prevalent as amyotrophic lateral sclerosis (7-9). Patients with genetically distinct forms of SCA, including SCA6, become disabled and may progress to severe incapacitation. Many patients die prematurely due to aspiration pneumonia or respiratory failure (10-12). The advent of modern molecular genetics has enabled the confirmed molecular diagnosis and characterization of the many distinct forms of SCA (13). The most reliable prevalence estimates of these heterogeneous disorders are on the order of 18-50/100,000 (9, 14). Thus, these disorders create a substantial economic and societal burden (15).

Insights into ataxia will aid in understanding other neurological disorders. There are extensive overlaps between SCA and other neurodegenerative diseases (NDs) (16-19). Although neuronal cell loss is most evident in the regions responsible for the principal clinical presentation of NDs, neurodegeneration is nearly always more widespread (20-23). Moreover, there is an increasing overlap in possible disease mechanisms. For example, there are growing mechanistic genetic overlaps between ALS and SCA2 (24) and SCA6 and epilepsy (25, 26). Thus, insights into molecular pathogenesis in each disease will have a wider impact on understanding neuronal death and dysfunction in other systems.

CACNA1A Genes and Disorders

The principal gene product of CACNA1A is the α1A subunit of the P/Q-type voltage-gated Ca$^{2+}$ channel. CACNA1A mutations of several types, leading to both loss and gain of channel function, are responsible for several types of neurological diseases, including episodic ataxia type 2, familial hemiplegic migraine, and epilepsy (27-29). The presence of the CAG repeat encoding a polyQ tract in the C terminus of the α1A subunit led us to the hypothesis that the polyQ expansion in SCA6 caused a pathological disturbance of P/Q channel function (30, 31). However, several in vitro and in vivo expression studies have failed to demonstrate a consistent effect on channel function (32-36). In particular, two separate studies using CACNA1A knock-in mice with SCA6 repeat expansions failed to demonstrate any change in P/Q channel gating properties in cerebellar neurons (37, 38). Therefore, it is unlikely that SCA6 is a "channelopathy" in the classical sense.

PolyQ Disorders and Disease

SCA6 is one of 9 neurodegenerative diseases (polyQ disorders) that are due to an expansion of a CAG repeat encoding a polyQ tract (17-19). These polyQ proteins have no other structural similarity, but several have nuclear functions relating to gene regulation (39). Toxicity in these other disorders depends on the flanking protein context of the polyQ tract, and is frequently associated with transport to the nucleus of the full length or a toxic fragment of the mutant protein (40, 41). SCA6 differs from the other polyQ diseases in at least three respects: (1) The size of the polyQ expansion that leads to SCA6, Q19-33, is small, well within a range of repeat size seen in normal alleles for other polyQ disorders, i.e., SCA1, 2, 3, Huntington's disease, or spinobulbar muscular atrophy (8, 13, 42); (2) The $Ca^{2+}$ channel protein expressing the polyQ tract causing SCA6 has rather restricted expression to neuronal cell types, most abundantly Purkinje cells, while other polyQ proteins are widely expressed outside the central nervous system (CNS) (13, 33, 43-45); and (3) Until recent studies, the polyQ expansion in SCA6 was found on a $Ca^{2+}$ channel subunit, whose only recognized function is mediating $Ca^{2+}$ conductance at the neuronal plasma membrane, while most other polyQ diseases appear to require entry of the pathological polyQ protein into the nucleus (22).

It has been shown that the C terminus of the α1A subunit (α1ACT), which contains the polyQ tract, is present as a stable fragment in cultured cells or cerebellar tissues (46-50). We were the first to demonstrate that this fragment is enriched in cerebellar nuclei, translocated based on nuclear localization signals in the α1ACT sequence (48). Finally, it has been shown that the α1ACT fragment bearing SCA6-expanded polyQs, unlike the full-length α1A subunit, is toxic to cultured cells or primary neurons (47-50). In experiments presented below, we explain both the origin and endogenous function of the α1ACT. We demonstrate that the CACNA1A gene is bicistronic and that the α1A mRNA contains a cryptic internal ribosomal entry site (IRES) that encodes the α1ACT protein. We further demonstrate that α1ACT containing the polyQ tract is a bona fide transcription factor that binds to non-coding regions of several Purkinje cell-expressed genes, enhancing their expression, and mediating neurite outgrowth in vitro and partial rescue of the CACNA1A knock-out phenotype in vivo. α1ACT with expanded polyQ has reduced transcription factor and neurite outgrowth function, altered DNA binding, is toxic to cells in vitro, and causes impaired motor coordination and cerebellar cortical atrophy in vivo.

The N Terminal Sequence of α1ACT

Figure 14A:
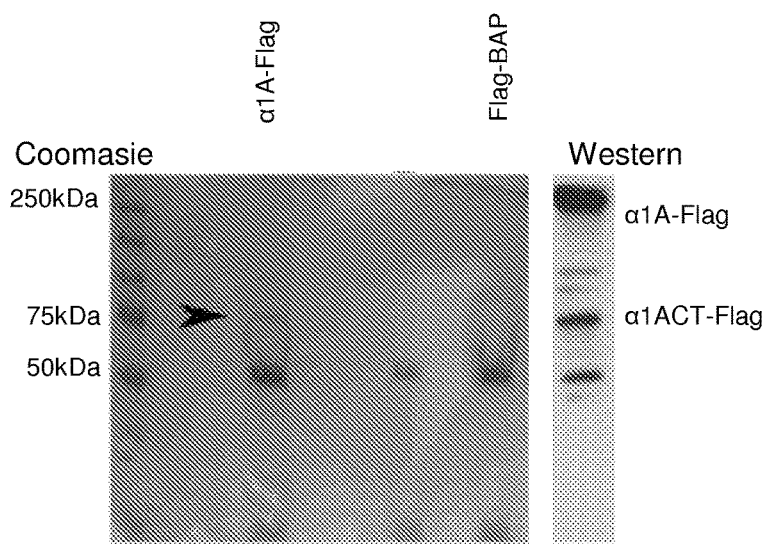
FIG. 14. The C terminal fragment of α1A subunit initiates at MIMEYYR (SEQ ID NO: 165) (amino acids 1960-1964, nucleotide 6114-6128) [A.] The eluted fraction from a DEAE column was incubated with anti-FLAG M2 magnetic beads overnight rinsed and eluted with FLAG. The purified proteins were separated by SDS-PAGE and stained with Comassie blue to identify a 75 kD band (arrow) as α1ACT. [B.] LC-MS/MS analysis of the protein revealed the starting AA sequence of N terminus of α1ACT fragment as Met Be Met Glu Tyr (SEQ ID NO: 166)(amino acids 1960-1964, nucleotide 6114-6128) (Genebank GI:187828892, NM_001127222, NP_001120694).
Figure 14B:
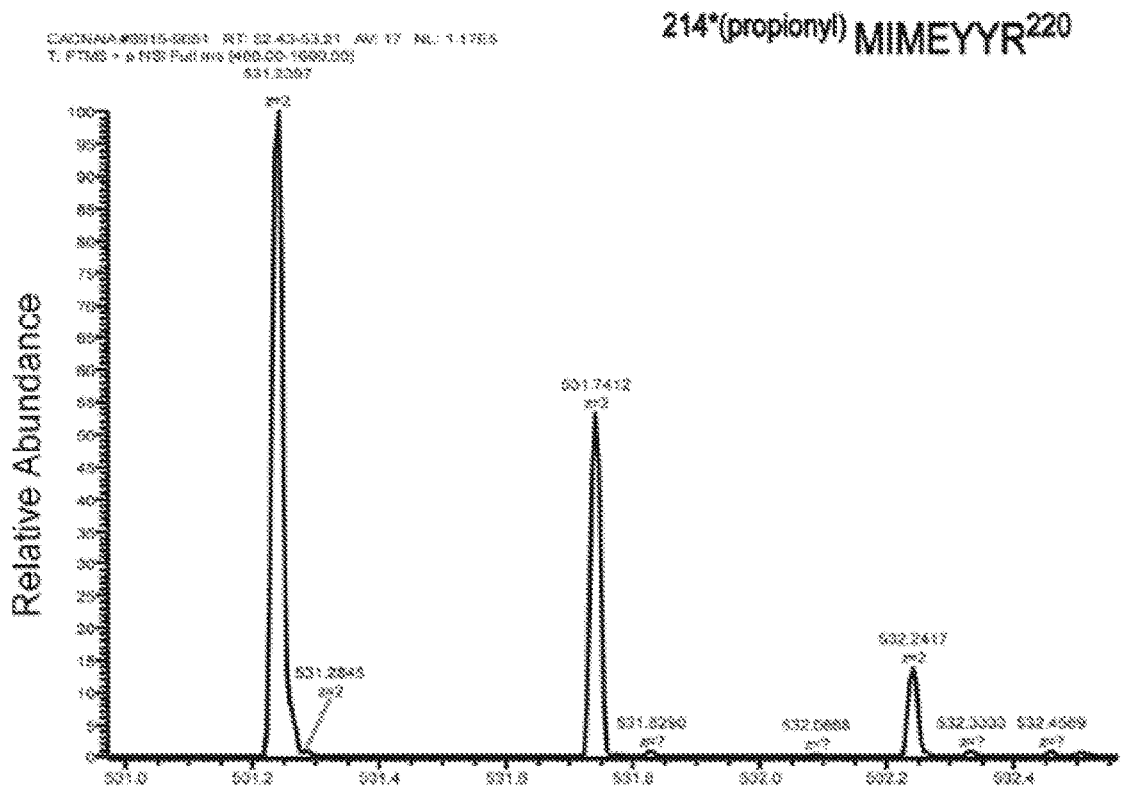

Several groups have detected a stable C terminal α1ACT polypeptide in cells and tissue; however, until now there have been no insights into the origin of this fragment (46-50). We performed a two-step column purification, using DEAE chromatography and anti-FLAG affinity chromatography to obtain a highly enriched preparation of a 75 kD FLAG-tagged α1ACT fragment produced in cells stably expressing the α1A subunit C terminally labeled with 3×FLAG. With the help of the Proteomics Resource Center at Rockefeller University we subjected the fragment to in-gel N-terminal propionylation and identified the N terminal sequence (start site) of the α1ACT fragment by mass spectrometry as beginning with MIMEYYR (SEQ ID NO: 165), corresponding to codon 1960 of α1A subunit (FIG. 14).

α1A mRNA Contains an IRES

Figure 15A:
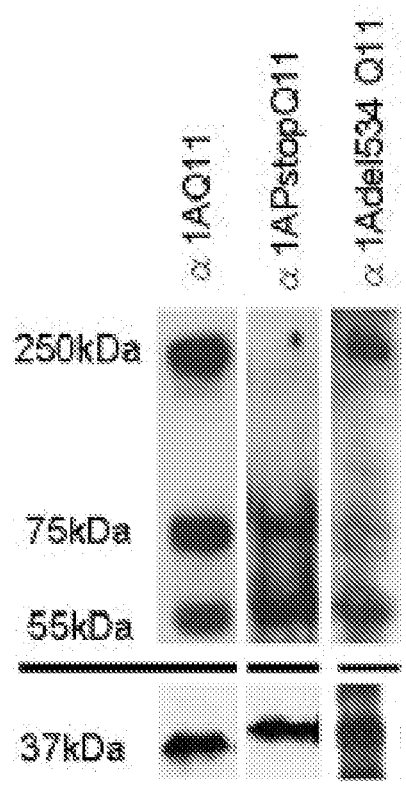
FIG. 15. α1A mRNA contains an IRES. [A.] Immunoblot of transfected cell lysates (anti-FLAG) showing 75 kD fragment of full length α1A$_{Q11}$ persists despite stop codon (α1APstopQ11) that abolishes full length 250 kD fragment. 75 kD fragment is eliminated with 534 bp deletion that has no effect on full length fragment. 55kD band corresponds to IgG. [B.] Four gene fragments from α1A cDNA were amplified by PCR and inserted into the bicistronic construct, pRF, to generate pRCTF and transfected into HEK293 cells with pβ-gal control plasmid to detect IRES activity. The ratio of Renilla luciferase (and firefly luciferase activities were determined and normalized to β-galactosidase activity. Data shown are mean±SD of three independent experiments (each involving triplicate assays).
Figure 15B:
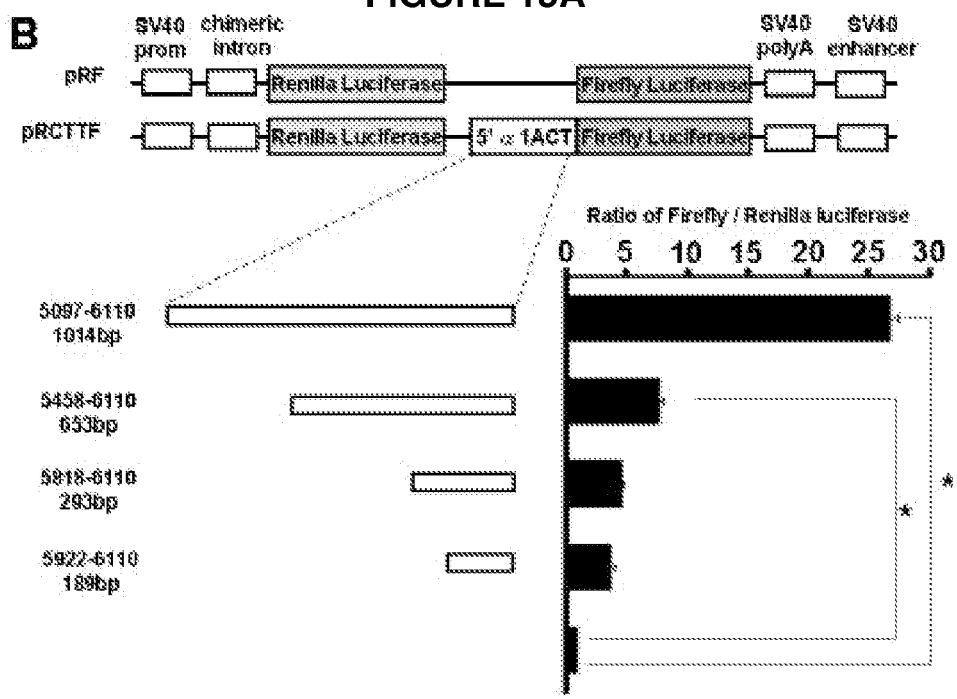

Insertion of termination codons, either 1847 (α1APstopQ11, FIG. 15A) or 1937 nucleotides, 5' to the α1ACT start site did not abolish α1ACT expression, indicating that the α1ACT fragment could be made separately from the α1A subunit. To test for the presence of a cryptic internal ribosomal entry site (IRES) upstream of the α1ACT start site within the α1A mRNA coding sequence we used a dual-luciferase, bicistronic reporter, pRCTF, consisting of the Renilla luciferase (R-Luc) gene, followed by a stop codon, a polycloning site, and the firefly luciferase (F-Luc) gene (FIG. 15).

Figure 16A:
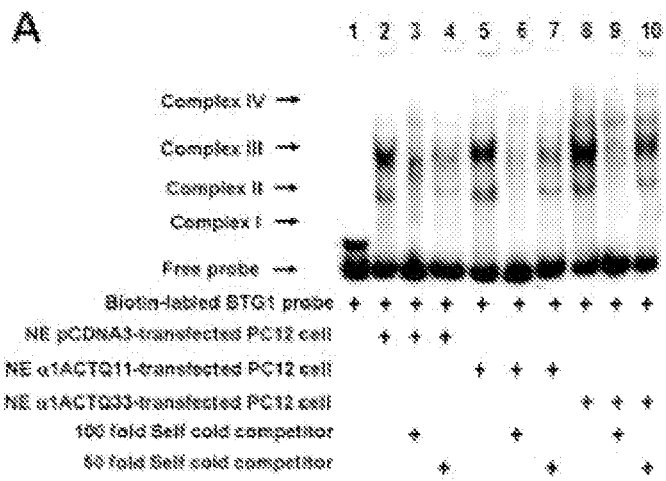
FIG. 16. [A.] Electrophoretic mobility gel shift assays show that α1ACT$_{WT}$ (Q11) and α1ACT$_{SCA6}$ (Q33) nuclear extracts (NE) interact with BTG1 3' UTR DNA probe specifically (Complex IV, lanes 5 and 8), although the α1ACT$_{SCA6}$ complex resists competition suggesting a greater affinity (lane 10). Incubation with anti-FLAG ab caused a supershift (not shown). [B.] EMSA showed that the TTATAA region was critical for the formation of nucleoprotein complexes with 517/600 element. Double-stranded, 3' biotin-labeled probes corresponding to the 517/600 element (WT), mut1, mut2, mut3 and mut4 were incubated with PC12 nuclear extracts. Mut1 abolished complex II. Mut2 abolished complex I. Mut4, combining Mut1 and Mut2, abolished both complexes I and II. Mut3 had no effect on protein/DNA complexes. [C.] Mutated BTG1 targets lose enhancer activity. PC12 cells stably expressing empty vector or α1ACT were transiently transfected with BTG1630WT, BTG1630mut1, BTG1630mut2, BTG1630mut3 and BTG1630mut4. The data were shown as mean±SD of three independent experiments (each involving triplicate assays. *p<0.005 vs. promoter construct). The sequences of FIG. 16C are presented in the Sequence Listing as SEQ ID NOs: 175-178 (top sequence to bottom sequence, respectively).

The presence of the stop codon after the R-Luc gene leads to only R-Luc activity. We inserted DNA fragments of four different sizes from the α1A cDNA (sequences 189, 293, 653 and 1014 nucleotides upstream of the α1ACT start site) into the cloning site between the luciferase genes. The 189- and 293-nucleotide sequences had no effect on F-Luc expression, while the 653- and 1014-nucleotide sequences increased F-Luc expression by 7-fold and 26-fold over R-Luc expression, respectively. RT-PCR demonstrated no difference in relative abundance of the F-Luc and R-Luc transcripts, excluding possibility of a cryptic promoter. These findings indicate that the α1A mRNA sequence upstream of α1ACT start site contains an IRES. Finally, deletion of 534 nucleotides upstream of α1ACT from α1A abolishes the α1ACT fragment without affecting the expression of full-length (−534) α1A (FIG. 15A).

α1ACT Binds to Non-Coding Regions of Cellular Genes through a Consensus Motif

α1ACT contains three nuclear localization signals and is enriched in the nucleus of cerebellar neurons and transfected cells (48). To investigate the role of nuclear α1ACT we performed ChIP with anti-FLAG antibody using cells expressing recombinant α1ACT bearing a FLAG tag and cloned the immunoprecipitated DNA using a plasmid vector. We found that α1ACT bound to non-coding regions of five genes, BTG1, GRN, PMCA2, TAF1 and ITGA8 (Table 6), all known to be expressed in Purkinje cells (63-65). Using the pair wise program, BIND (BONDplus in Biomolecular Interaction Network Database) we predicted the motif, TTATAAAA as an eight-nucleotide consensus sequence common to the five targeted genes. Using electrophoretic mobility shift assays we found that this motif, but not mutations of this motif, was able to effectively compete with two of the gel-shift complexes formed with the BTG1 3' UTR and nuclear extracts of α1ACT-expressing cells (FIG. 16A,B). Thus α1ACT fulfils the criteria for a transcription factor.

TABLE 6

Neuronal genes identified by α1ACT ChIP-cloning

| NAME | | GENBANK ACCESSION | LENGTH | POSITION |
|---|---|---|---|---|
| TATA box binding protein-associated factor | TAF1 | NG_012771 | 171 bp | Introns Aha repeat |
| B-cell translocation gene 1 | BTG1 | NM_017258 | 100 bp | 3'UTR532-631 |

TABLE 6-continued

Neuronal genes identified by α1ACT ChIP-cloning

Figure 17A:
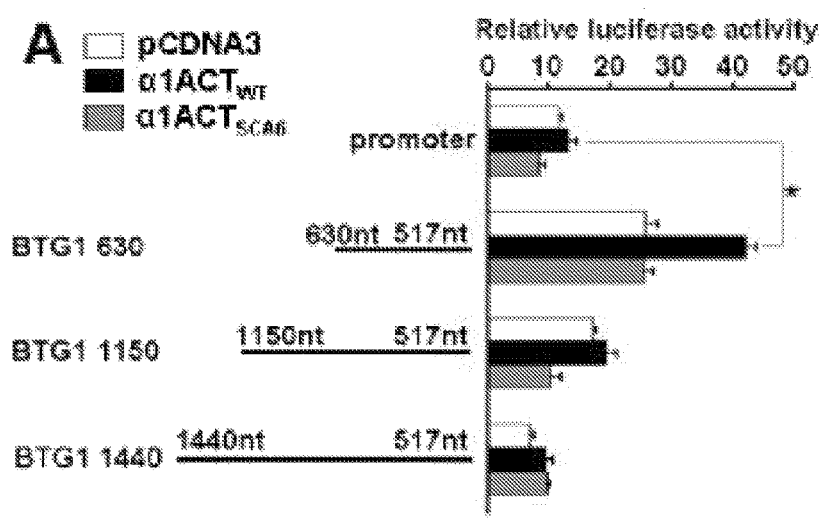
FIG. 17. α1ACT$_{WT}$(Q11), but not α1ACT$_{SCA6}$(Q33) enhances expression of ChIP-targeted genes. [A.] α1ACT$_{WT}$, but not α1ACT$_{SCA6}$, increases luciferase expression through a 113 bp (630-517) 3' UTR sequence in BTG1. [B.] α1ACT$_{WT}$, but not α1ACT$_{SCA6}$, increases luciferase expression through a 630 bp (632-1) 5' UTR sequence in granulin (GRN). [C.] Relative RNA expression levels of TAF, BTG1, PMCA2 and GRN in PC12 cells transfected with α1ACT (n≥3, p<0.005). [D.] Relative RNA expression levels of BTG1 relative to endogenous Pcp2 gene in cerebellum from two SCA6 patients (both Q22) compared to control cerebellum.
Figure 17B:
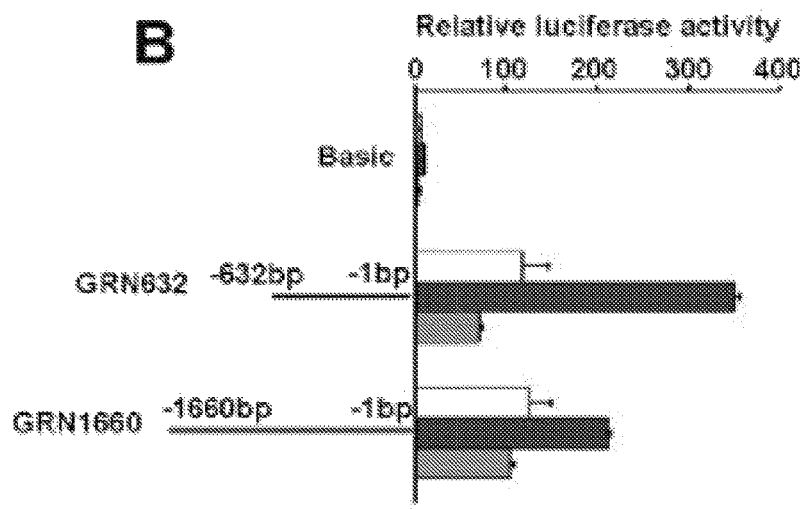
Figure 17C:
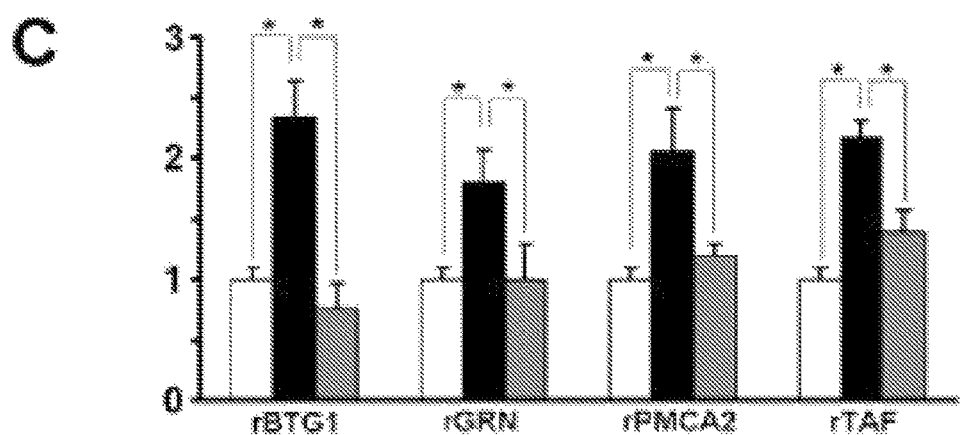

| NAME | GENBANK ACCESSION | | LENGTH | POSITION |
|---|---|---|---|---|
| Granulin | GRN | NG_007886 | 153 bp | 5'UTR 6793-6930 |
| Ca++ ATPase, plasma membrane 2 | PMCA2 | NM_012508 | 186 bp | 5'upstream 9822 bp |
| Integrin alpha-8 precursor | ITGA8 | EF444991 | 1227 | Intron 22 153367-154427 |

α1ACT with Normal PolyQ (but Not α1ACT with Expanded PolyQ) Enhances Expression Through the Identified Enhancer Elements We subcloned three of the target non-coding sequences in Table 6, BTG1 3' UTR (FIG. 17A), GRN 5' UTR (FIG. 17B), and PMCA2 5' UTR (not shown) into the PGL3 luciferase reporter, containing a minimal promoter, and tested for the ability of the α1ACT to enhance reporter activity. We found that cells transfected with these constructs together with the α1ACTWT (Q4) plasmid had a 3-5-fold increase in luciferase expression.

Figure 17D:
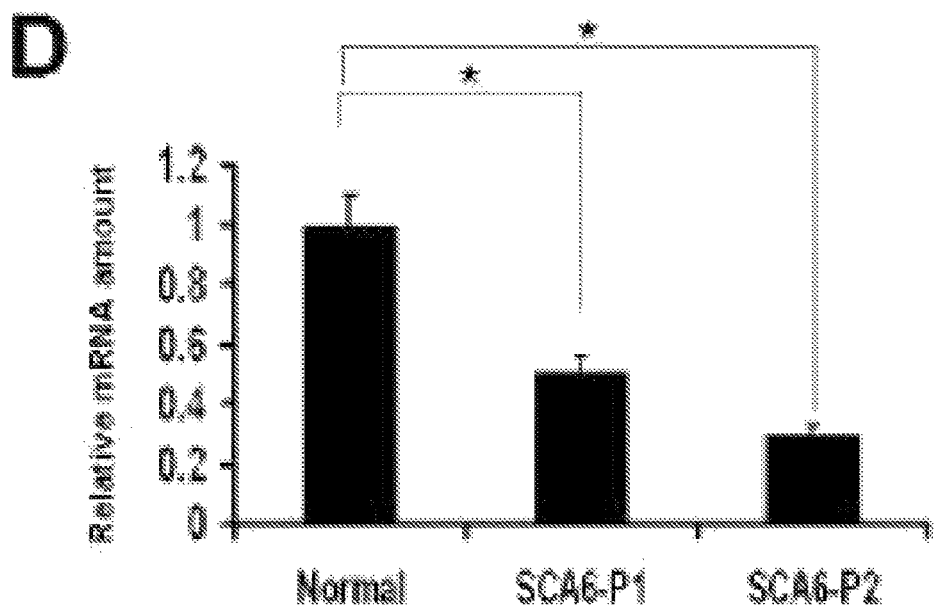

Cells expressing luciferase reporters and α1ACT$_{SCA6}$ plasmid cloned from an individual with SCA6 exhibited significantly less luciferase expression. PC12 cells expressing α1ACT$_{WT}$ (Q11) have increased expression of these targeted genes. mRNA isolated from frozen cerebellum from two SCA6 patients had reduced BTG1 mRNA relative to endogenous Pcp2 gene (FIG. 17D). These findings indicate that expanded polyQ in the α1ACT polypeptide interferes with its transcription factor function.

α1ACT with Normal PolyQ (but not α1ACT with Expanded PolyQ) Enhances Neurite Outgrowth of Differentiating PC12 Cells.

Figure 18A:
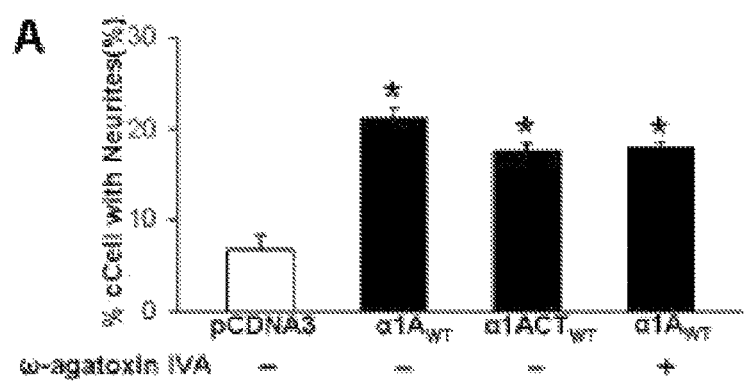
FIG. 18. [A.] Quantitation of neurite outgrowth in transient transfected cells. Cells expressing full length (Q11FLAG) and α1ACT (5821FLAG) had significantly greater neurite outgrowth than control (PCDNA3). ω-agatoxin did not block neurite outgrowth. [B.] Quantitation of neurite outgrowth in transfected cells. The number of PC12 cells with neurites was increased 2 fold in the cells over-expressing α1ACT$_{WT}$ over cells expressing pcDNA3. The number of cells with neurites was decreased 20% in PC12 cells over-expressing α1ACT$_{SCA6}$ compared with PC12 cells expressing pcDNA3 (N=3, P<0.005). [C.] α1ACT induced neurite outgrowth. Immunofluorescence of PC12 cells with transiently transfected pcDNA3-FLAG, α1ACT$_{WT}$-FLAG and α1ACT$_{SCA6-FLAG}$. Anti-FLAG staining was shown in red and nucleus was stained blue with DAP1. The GFP protein was co-transfected to visualize PC12 cell body and neurites. The PC12 cells expressing α1ACT$_{WT}$-FLAG and α1ACT$_{SCA6}$-FLAG show strong anti-FLAG staining (red) of nuclei (blue) and lighter staining of neurites compared with pcDNA3.
Figure 18B:
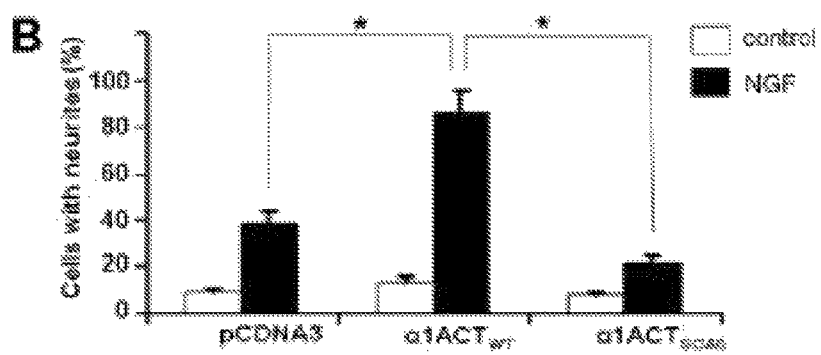
Figure 18C:
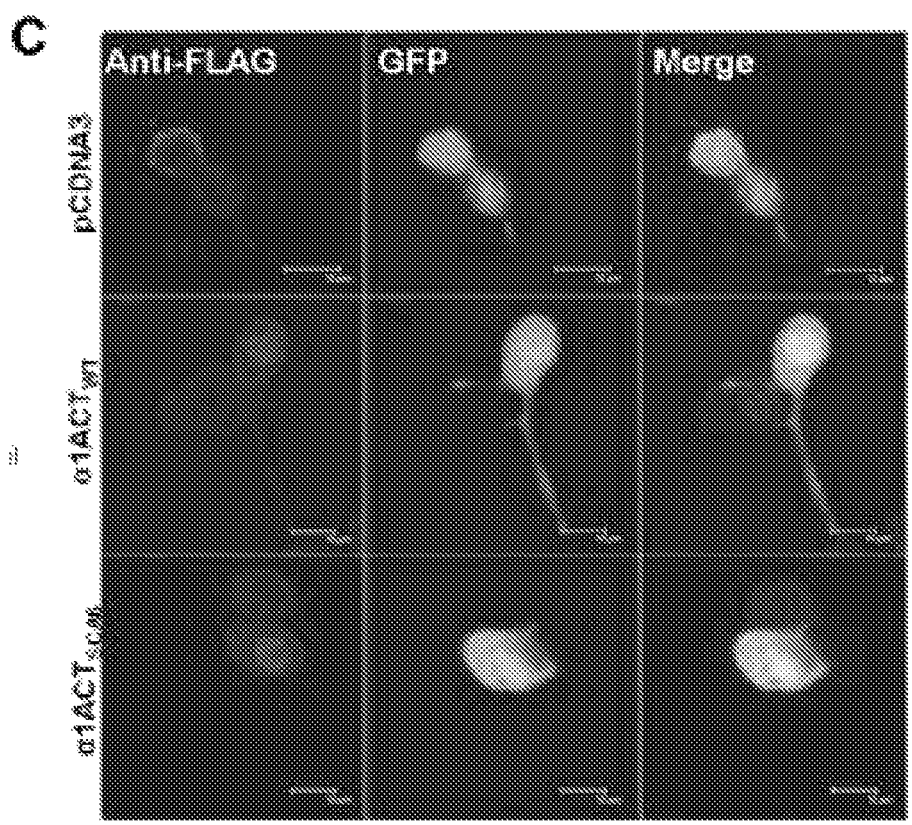

To test the biological properties of α1ACT in a cellular system we established stable PC12 cell lines expressing α1ACT$_{WT}$ (Q11) or α1ACT$_{SCA6}$ (Q33) fragments, or the corresponding full length α1A$_{WT}$ and α1A$_{SCA6}$, and treated cells with nerve growth factor to induce differentiation into the neuronal phenotype. We found that cells expressing either α1A$_{WT}$ full length or α1ACT$_{WT}$ had enhanced neurite outgrowth relative to control plasmid expressing cells. This effect was not blocked by incubation of α1A$_{WT}$ full length-expressing cells with the P/Q type Ca$^{2+}$ channel blocker, ω-agatoxin (FIG. 18A). Interestingly cells expressing α1ACT$_{SCA6}$ had severely diminished neurite outgrowth under the same conditions (FIG. 18B, C). This indicates that expanded polyQ may cause partial loss of transcription factor function in vitro. The relationship of this property to SCA6 pathogenesis remains to be clarified (2, 66).

α1ACT Normalizes Purkinje Cell Afferents in α1A$^{-/-}$ Mice. α1ACT with Expanded PolyQ do not Yield Viable Mice.

Homozygous α1A KO mice (α1A$^{-/-}$) are severely neurologically impaired with seizures, dystonia and ataxia, disrupted cerebellar cortical development, and die before 3 weeks of age. To test for the function of α1ACT in vivo, we asked whether α1ACT expression restricted only to Purkinje cells could ameliorate any of the phenotype of the α1A$^{-/-}$ mice. We generated conditional mutant transgenic mice expressing α1ACT$_{WT}$ in Purkinje cells using the Pcp2 promoter and the tetracycline transactivator protein (tTA) to target these cells. On a normal CACNA1A background these mice appear normal and have high levels of α1ACT expressed in nuclei and cytoplasm of Purkinje cells (FIG.

Figure 19A:
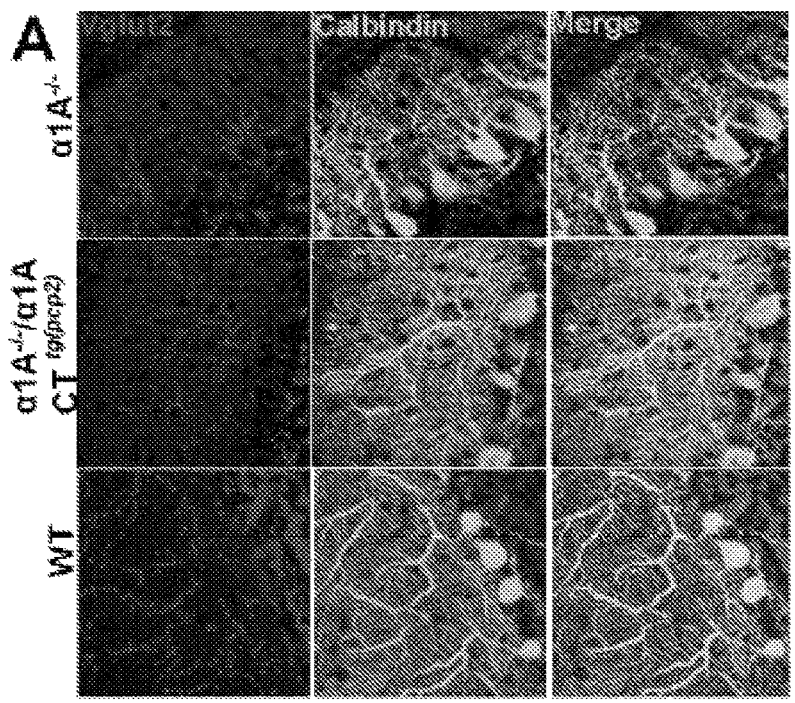
FIG. 19. Purkinje cell-targeted expression of α1ACT$_{WT}$ partially rescues α1A$^{-/-}$ CACNA1A phenotype. [A.] Immunofluorescence of CFs in α1A$^{-/-}$, α1A$^{-/-}$/α1ACT$^{tg(Pcp2)}$ and WT mice. Anti-vGlut2 staining was shown in red and the dendrite of Purkinje cells was stained green with Calbindin. The mice were perfused and sacrificed at postnatal day 17. [B.] Upper: Quantitation of Purkinje cells with multiple climbing fibers. Lower: quantitation of relative somatic vs dendritic innervation. [C.] Excitatory postsynaptic currents (EPSCs) of α1A$^{-/-}$, α1A$^{-/-}$/α1ACT$^{tg(Pcp2)}$ and WT mice, aged 16-17 days. Left: Representative recordings of EPSCs from, paired stimulus protocol. Right: Amplitude of EPSC1 as a function of stimulus intensity.
Figure 19B:
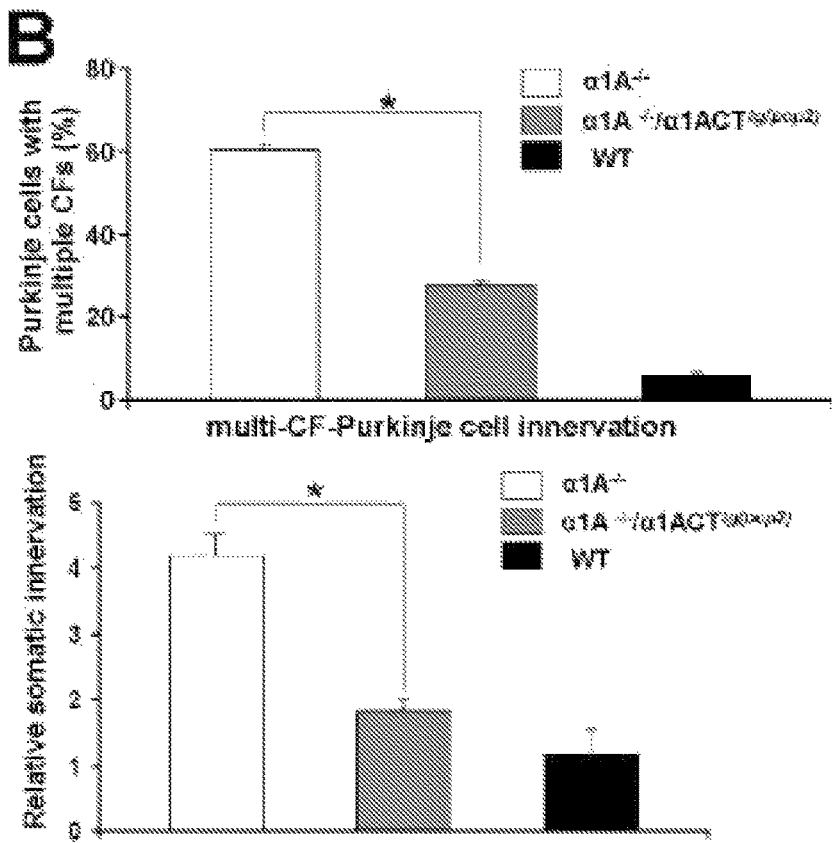
Figure 19C:
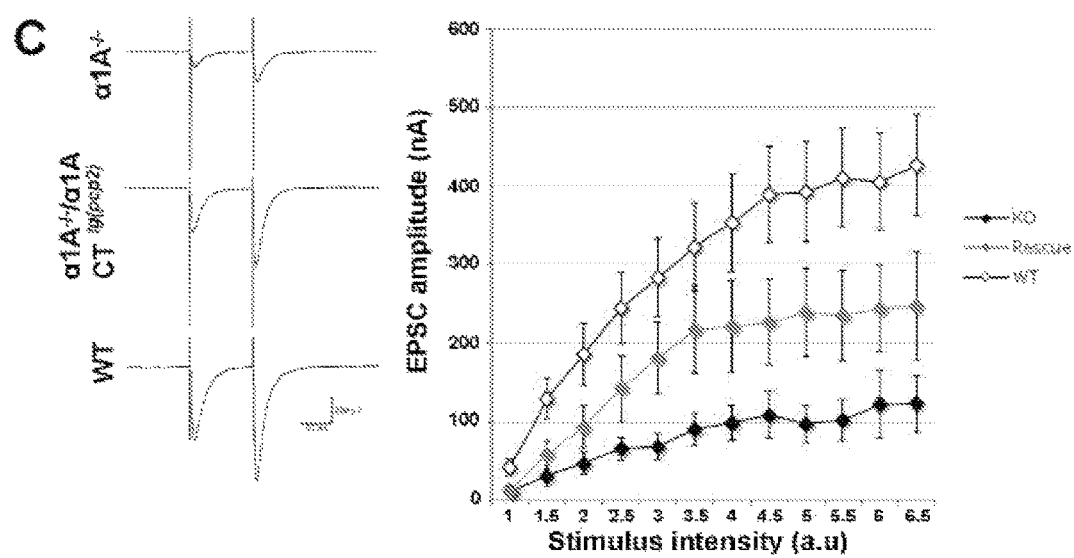

20A). We bred these mice with the α1A$^{+/-}$ mice to establish mice expressing α1ACT on a CACNA1A null (α1A$^{-/-}$) background. We found that, although still impaired neurologically, the α1ACT$_{WT}$/α1A$^{-/-}$ mice moved considerably better than their α1A$^{-/-}$ littermates. More importantly, the cerebellar Purkinje cell morphology and innervation were significantly improved (FIG. 19A,B). The height and branching of Purkinje cell dendrites of α1ACT$_{WT}$/α1A$^{-/-}$ mice appeared nearly normal. Immuno-histochemical localization of both parallel and climbing fiber afferents using the Vglut1 and Vglut2 antibodies showed essentially a normal pattern of innervation. In comparison, α1A$^{-/-}$ mice had immature afferent innervation and Purkinje cells with short dendritic trees with abnormal branching (FIG. 19A, B). In electrophysiological studies of cerebellar slice preparations of these mice it was found that, excitatory postsynaptic currents (EPSCs) evoked by parallel fiber stimulation of slices from 17-day-old α1A$^{-/-}$ mice were extremely depressed with minimal increase with stimulus intensity, EPSCs recorded from α1ACT$_{WT}$/α1A$^{-/-}$ slices were intermediate in amplitude to those in WT mice of the same age and showed a stronger correlation with stimulus intensity, as in WT mice. Curiously, no transgenic mice expressing α1ACT$_{SCA6}$ together with α1A$^{-/-}$ were obtained despite extensive breeding. These findings indicate that the normal α1ACT terminus expressed in Purkinje cells plays a key role in maturation of the cerebellar cortex. It is possible that the SCA6-associated α1ACT$_{SCA6}$ fragment, on a CACNA1A null background, exerts a lethal effect at an early age.

α1ACT$_{SCA6}$ Expressed in Purkinje Cells on a Normal CACNA1A Background Causes Impaired Motor Coordination and Thinning of the Cerebellar Molecular Layer.

Because SCA6 is an autosomal dominant disorder we tested whether over-expression of the SCA6-expanded α1ACT$_{SCA6}$ fragment would lead to clinical or pathological features resembling SCA6, compared with over-expression of the wild-type α1ACT$_{WT}$ having the wild-type, typical or normal length CAG repeat.

Figure 20A:
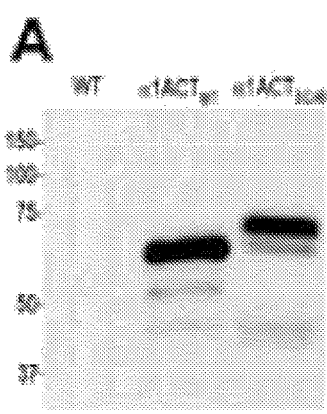
FIG. 20. Purkinje cell-directed expression of α1ACT shows allele-specific pathogenicity of α1ACTSCA6. [A.] Western blot showing equivalent expression of α1ACT$_{WT}$ and α1A$_{CTSCA6}$ in different lines. [B.] Treadmill analysis of gait shows increasing paw angle variability in 3 and 6 month old mice expressing α1ACT$_{SCA6}$ compared with WT and α1ACT$_{WT}$. [C.] Cerebellar cortex of WT, α1ACT$_{WT}$ and α1ACT$_{SCA6}$-expressing transgenic mice age 2-2.5 years, stained with calbindin and alexa-488. [D.] Quantitation molecular layer thickness: n=3, p<0.05.
Figure 20B:
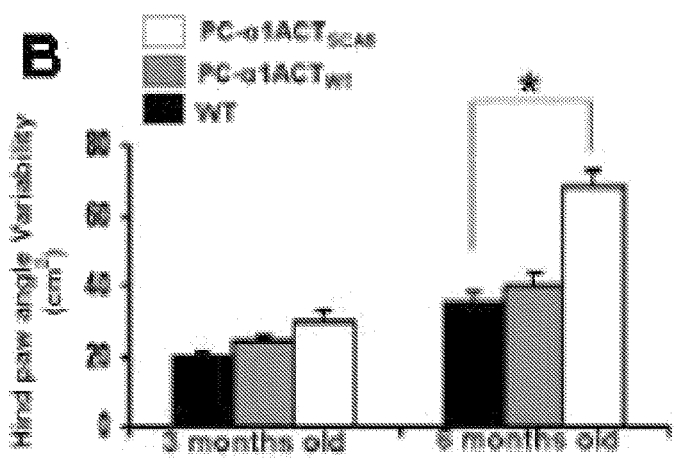

We developed several lines of each transgenic, whose expression was targeted based on the Pcp2 promoter using the tet-off system. Others have found that the Pcp2-tTA transgene line provides the most consistent uniform expression of dominant genes under control of the tet responsive element (67). We established two α1ACT$_{WT}$ and α1ACT$_{SCA6}$ lines with matched levels of expression (FIG. 20A) and compared the phenotypes at different ages. There were no obvious clinical differences between these two lines in young adults. However, using a video-assisted computerized treadmill for gait analysis (Digigait, CleverSys), we measured obvious differences in several gait parameters at ages 3 and 6 months that suggested a progressive gait disturbance consisting of several abnormalities including increased paw angle variability (FIG. 20B).

Figure 20C:
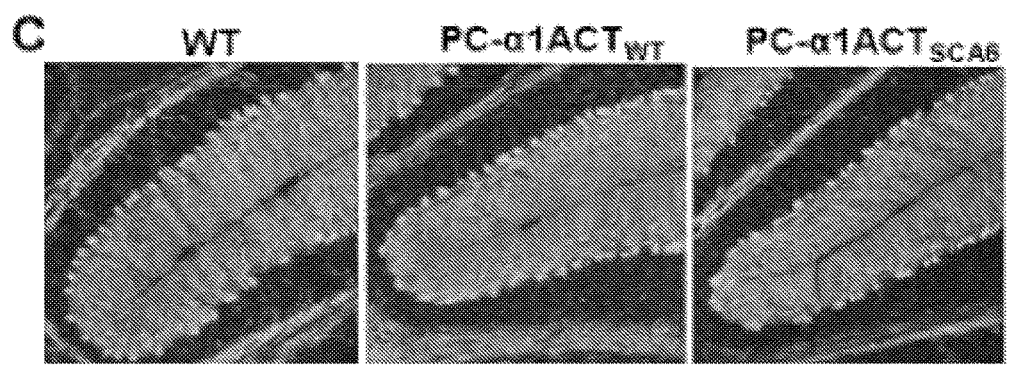

The gait disturbance never progressed to the level of severe ataxia over the first year, although natural changes in weight gain may have obscured an impact on normal cage activity. Lifespan was not affected. We looked for pathological changes in the cerebellum at approximately 2 years of age. There was no obvious sign of cell loss or increased markers of apoptosis in α1ACT$_{SCA6}$ mice. However, measurement of the molecular layer thickness showed that α1ACT$_{SCA6}$-expressing mice have significant thinning of the molecular layer, compared with age-matched α1ACT$_{WT}$ and WT mice (FIG. 20C, D). These findings are the first to demonstrate clinical and pathological changes in an animal model of SCA6 expressing appropriate-sized pathological alleles within a CACNA1A protein. The lack of severe ataxia in 2-year-old mice is not surprising for a model of SCA6, with an age of onset of 43-52 years.

α1AQ14 Knockin Mice Hemizygotes (α1A EX47Q14/−) Develop Seizures, Dystonia, Ataxia, Stress-Induced Motor Spells and have Disrupted Cerebellar Cortical Development.

A recent paper describing CACNA1A knockin mice (α1A$^{Ex47Qn}$), in which the human CACNA1A exon 47 encoding Q14, or expanded polyQ tracts (Q30, Q84), inserted in place of mouse exon 47 failed to identify a C terminal fragment in mouse cerebellar homogenates, using two anti-C terminal antibodies (38). This finding contradicts the observations of several other laboratories (46-50). However, the authors also found that the α1A$^{Ex47Qn}$ mice have a disturbance in the normal proportions of α1A mRNA spliceforms. We obtained the α1A$^{EX47Qn}$ knock-in mice and confirmed that the α1ACT C-terminal fragment was undetectable, indicating a problem with expression. Although homozygous α1A$^{EX47Q14/Q14}$ mice seemed clinically normal, we further analyzed them using a classical genetic complementation experiment: We bred α1A$^{EX47Q14/Q14}$ mice with α1A knockout mice (α1A$^{-/-}$) and compared phenotypes of 5 mouse lines (α1A$^{-/-}$, α1A+/−, α1A$^{EX47Q14/Q14}$, α1A$^{EX47Q14/+}$ and α1A$^{EX47Q14/−}$). The α1A$^{-/-}$ mice exhibited dystonia and ataxia and died by day 21. Unexpectedly, in comparison to α1A$^{+/-}$, α1A$^{EX47Q14/Q14}$ and α1A$^{EX47Q14/+}$ mice, which were all clinically normal, all α1A$^{EX47Q14/-}$ mice (KIKO mice) (N=21) exhibited a fairly typical CACNA1A mutant phenotype of seizures, dystonia, ataxia and stress-induced motor spells beginning around day 10 until age six months. We determined that α1A$^{EX47Q14/-}$ mice showed significantly higher frequency and duration of stress-induced spells than all other mice, some lasting 30 minutes (68, 69). Digigait analysis showed abnormalities in several gait parameters, including increased paw area variability (FIG. 21A). These abnormalities appear to reduce with age. Finally, examination of cerebellar histology of KIKO mice revealed a disturbance in both Purkinje cell dendrites and afferent innervation (FIG. 21B, C). Purkinje cell dendrites are shorter, with fewer proximal branches and spine density than in WT mice. In addition, climbing fiber afferents stained with Vglut2 antisera demonstrated an immature or disrupted pattern of contacts with proximal dendrites compared with WT mice. These changes were not seen in either α1A$^{+/-}$ or α1A$^{EX47Q14/+}$. These findings indicate some as yet undefined problem with CACNA1A expression in α1A$^{EX47Q14}$ Knock-in mice, relating to species or position effects, that leads to disturbed cerebellar development. Given that these mice have normal P/Q channel function, as judged by cerebellar slice recordings (38), it is likely that the change relates to the alteration in this newly identified role of the CACNA1A gene in cerebellar cortical development. This conclusion is consistent with absence of the α1ACT and actually supports, rather than contradicts, our findings of the role of the α1ACT in cerebellar development. Therefore, mice engineered using this knock-in strategy are not appropriate for a SCA6 model.

Analysis of the SCA6 PolyQ Expansion in α1ACT in the Transcription Factor (α1ACT$_{SCA6}$) and Determining if the SCA6 PolyQ Expansion Changes the Gene Binding Patterns and the Expression Patterns of Purkinje Cell Genes α1ACT$_{WT}$ augments PC12 cell neurite outgrowth and binds and enhances expression of a set of Purkinje cell genes through a consensus motif. The α1ACT$_{SCA6}$ severely blunts neurite outgrowth, has lost the effect on Purkinje cell genes, and causes impaired gait and cerebellar cortical atrophy in vivo. Thus, α1ACT$_{SCA6}$ may cause SCA6 by its effect on key transcript levels. We hypothesize that the α1ACT$_{SCA6}$ will have different binding profiles and target gene expression profiles than α1ACT$_{WT}$.

Figure 16B:
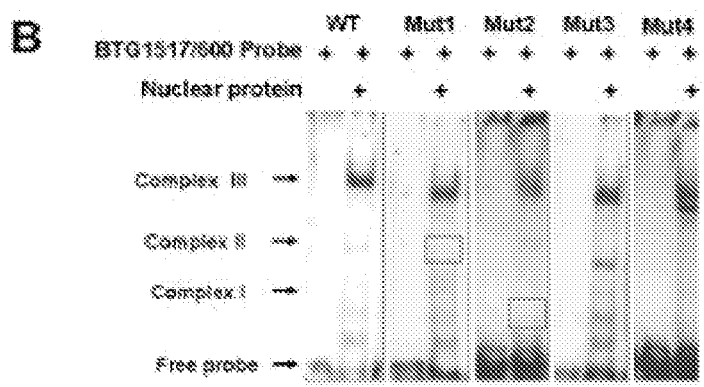
Figure 16C:
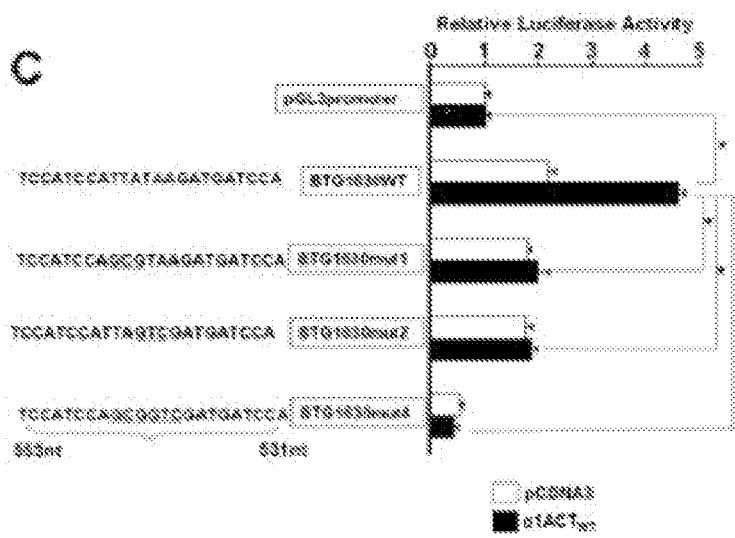

We will improve our understanding of the role of α1ACT$_{WT}$ as a transcription factor and the modified role of α1ACT$_{SCA6}$ by extending ChIP-cloning studies in PC12-derived lines expressing FLAG-tagged α1ACT$_{WT}$ protein. This approach already led to the finding that α1ACT$_{WT}$ binds to several gene targets bearing a consensus motif TTATAA (Table 6 and FIG. 16). It provides a highly pure, cross-linked preparation and employs high affinity antibody for ChIP, and is preferable to switching to a transgenic cerebellar source, which would invite more challenges with purification. The in vivo binding of both α1ACT$_{WT}$ and α1ACT$_{SCA6}$ in PC12 cells will be detected using ChIP coupled to next generation sequencing (NGS) which will identify the binding profiles in a unbiased and more quantitative fashion than ChIP subcloning. This will be done in the IGSB genome sequencing facility.

Figure 20D:
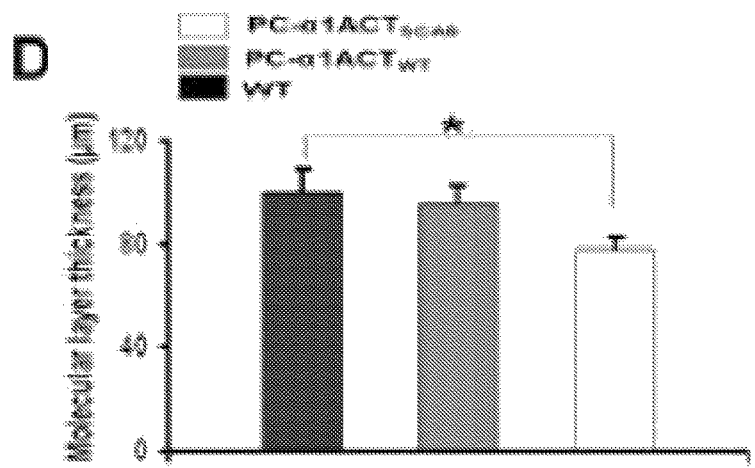

Second, because α1ACT$_{SCA6}$-expressing mice develop thinning of the cerebellar molecular layer (FIG. 20D), there may be differences in transcriptome of α1ACT$_{SCA6}$ and α1ACT$_{WT}$ Purkinje cells (PCs). We hypothesize that differences in RNA expression patterns will correlate with those of gene occupancy as determined in the ChIP-Seq, and will reveal key affected pathways that underlie the disease. PC-specific RNA will be isolated from these two lines by laser-capture microdissection (LCM), synthesized into cDNA and tagged with linkers for NGS in the IGSB core for an RNA-Seq comparison of gene expression patterns. Mouse groups aged 3 months (clear motor phenotype) and 2 years (clear pathological phenotype) will be used for transcriptome study. RNA-seq is superior to microarray, based on lower background signal, a much greater dynamic range, better quantitation, and more information about splice variants for quantified transcript levels.

General Procedure and Design

ChIP and RNA isolation. PC12 cells stably expressing α1ACT$_{WT}$ or α1ACT$_{SCA6}$ C-terminally tagged with 3×FLAG or background genomic control PC12 cells expressing pCDNA3 vector are again used as a source for ChIP. Chromatin is cross-linked, sonicated and immunoprecipitated by the monoclonal antibody anti-FLAG M2 (Sigma). After recovery of free DNA, the 15-20 ng of ChIP-enriched or control raw DNA is submitted to the IGSB core (70). The transgenic mice expressing α1ACT$_{WT}$ and α1ACT$_{SCA6}$ aged 3 months and 2 years and background control WT mice are used as source of Purkinje cell RNA. Cerebellums are snap frozen in OCT and 10 μm sagittal sections are collected on standard LCM slides. After HE staining, PCs easily visualized by phase contrast microscopy are extracted using a laser capture microdissector equipped with a dissecting UV-laser beam (Leica AS LMD http://pathcore.bsd.uchicago.edu/Home.shtml). RNA is isolated from 100-150 PCs using PicoPure RNA isolation Components (Applied Biosystems) following the manufacture's instructions. The 2~4 μg of total RNA is submitted to the IGSB core.

Preparation of ChIP-seq and mRNA-seq libraries. Sequencing libraries will be prepared with the Illumina ChIP-seq DNA and Illumina TruSeq RNA Sample Prep Kits according to Illumina's instructions in IGSB genome sequencing facility. After adapter ligation, library fragments of ~250 bp are isolated from an agarose gel. The DNA is PCR amplified with Illumina primer for 18 (ChIP-seq) for 15 (RNA-seq) cycles, purified, and loaded on an Illumina flow cell for cluster generation. Libraries are sequenced on Illumina HiSeq2000.

ChIP-Seq Analysis.

The bioinformatics support for Illumina runs in the core facility are to convert the raw output into called bases. Filtered reads are mapped to the rat genome (UCSC genome browser assembly rn4) using Bowtie. (http://bowtie-bio.sourceforge.net/index.shtml). Up to two mismatched base pairs are allowed, and the first 2 base pairs of the read are unused, as they show significant sequence bias for 'C' at the expense of 'T' base pairs. Sequence tags that map to more than one location in the genome are excluded. Peak discovery is performed using Model-based Analysis of ChIP-Seq (MACS). Negative control libraries consisting of input chromatin from PC12 cells expressing pCDNA3 vector is also generated and fed to MACS (http://liulab.dfci.harvard.edu/MACS/). The peaks identified from ChIP studies are categorized relative to genomic features such as binding to a promoter, enhancer, exon or intron. In silico analysis of α1ACT binding sites within peaks are performed by MEME (http://meme.nbcr.net/meme/intro.html) using both strands, a minimum occurrence of 50 sites in the data set, and minimum motif size of 8 bases to compare the binding motifs. $\alpha1ACT_{WT}$ and $\alpha1ACT_{SCA6}$ binding motifs determined by MEME are compared.

RNA-Seq Analysis of Purkinje Cell-Specific RNA.

Image analysis and base-calling are done using Illumina Genome Analyzer Pipeline software with default parameters. Filtered reads are mapped to the mouse reference (UCSC genome browser assembly mm9) and a custom splice-junction library based on UCSC known genes using the Cufflinks software. Mapped reads for all six mouse lines are compared with the annotated genes in the RefSeq database. The analysis of the RNA-seq data helps distinguish between up- and down-regulated transcripts, and flagged if Cufflinks finds its expression level to be significantly different by P-value using WT mice as the control. To obtain a global view of the changes in gene expression upon $\alpha1ACT_{WT}$ and $\alpha1ACT_{SCA6}$, gene ontology analysis of data will be performed using DAVID software (71).

As we have shown that α1ACT is a sequence-specific transcription factor we expect to find a broader array of predominantly Purkinje cell-expressed genes to which α1ACT binds in the promoter, intron, and 5' and 3' regions through to its cognate DNA sequence motif (72). The expression of $\alpha1ACT_{WT}$ ChIP-cloned genes is reduced in $\alpha1ACT_{SCA6}$ cell lines and in SCA6 ataxia cerebellum (FIG. 17D). Therefore, we expect to characterize several more affected genes, enabling the description of the pathways altered by the SCA6-expanded α1ACT. The only other unbiased study of chromatin binding by polyQ proteins was with huntingtin (Htt). Htt does not bind via consensus recognition motif, but occupies several gene promoters in vivo in a polyQ-dependent manner, disturbing gene function (73). Therefore, although the expanded polyQ tract in SCA6 α1ACT is much smaller than in HD, we anticipate that the $\alpha1ACT_{SCA6}$ ChIP study will reveal expanded gene occupancy, whose interacting regions may by more widespread, lacking a consensus motif (73).

For the RNA-seq study, we anticipate that differences (loss or gain of expression of transcripts) will be due to direct pathological effects of α1ACTSCA6 on gene expression, and secondary (compensatory or reactive) changes. The overlapping gene expression profile between ChIP-seq and RNA-seq will be first verified by qRT-PCR and then reporter assay. Alternatively, as in the case of androgen receptor, where polyQ tract length alters its interaction with some transcription co-activators (74), transcript levels in SCA6 may be altered in genes whose ChIP-enrichment is not altered by the expanded polyQ tract.

Analysis of α1ACT Expression by CACNA1A IRES and Promoter and Determination of Whether it Reproduces the Normal and Pathological Functions of a 1ACT Our α1ACT transgenics confirm the pathogenicity of $\alpha1ACT_{SCA6}$ vs $\alpha1ACT_{WT}$ (FIG. 20), although the model is incomplete due to the restricted expression to Purkinje cells and the use of a non-IRES-based construct. We will generate new α1ACT lines that include the CACNA1A IRES, preceded by a stop codon to generate $\alpha1ACT_{WT}$ or $\alpha1ACT_{SCA6}$ protein by CAP-independent translation. We will use the tet-off expression system to drive conditional expression and a CACNA1A-tTA transgene to generate the correct expression pattern. This study will confirm our expectations that: (1) The CACNA1A IRES mediates endogenous expression of α1ACT; (2) $\alpha1ACT_{WT}$, expressed under control of the endogenous CACNA1A IRES and promoter will more completely correct the developmental abnormalities of the CACNA1A mutants $\alpha1A^{-/-}$ and, in particular, $\alpha1A^{la/la}$ (leaner); and (3) The mutant protein, $\alpha1ACT_{SCA6}$, will create an effective model for SCA6. These mice will enable us to explore the involvement of the gene pathways identified in the study described above in more realistic models of α1ACT expression. More importantly, they will establish an animal model suitable for testing IRES-interacting drugs detected in the study described below that could be potential therapies for SCA6.

Attempts to generate SCA6 transgenic models have employed three distinct strategies: (1) targeted insertion of the full length α1A cDNA from a fully-spliced α1A mRNA encoding a Q28 (or Q13) repeat expansion into the CACNA1A gene (37); (2) targeted insertion of a human exon 47 bearing Q14, Q30 or Q84 repeats into the mouse CACNA1A gene ($\alpha1A^{EX47Qn}$) (38); and (3) the present strategy, conditional expression of the $\alpha1ACT_{WT}$ or $\alpha1ACT_{SCA6}$ selectively in Purkinje cells alone using the Pcp2-tTA tet-off system (FIG. 20) (67, 75, 76).

Neither of the first two strategies produced any clinical, electrophysiological or pathological changes in mice bearing SCA6-sized alleles. The $\alpha1A^{EX47Qn}$ mice bearing Q84 super-expansions ($\alpha1A^{EX47Q84}$), not seen in SCA6 patients, develop protein aggregates and symptoms as older mice (38). However, there is compelling evidence this exon 47 knockin strategy has led to aberrant expression of α1A splice forms and a hypomorph allele, suggesting that the resultant mice are not a valid model for SCA6 (FIG. 21)(38).

On the other hand, $\alpha1ACT_{SCA6}$ mice with Purkinje cell-targeted expression of the $\alpha1ACT_{SCA6}$ develop motor incoordination and thinning of the cerebellar molecular layer by age 2 years (FIG. 20). Since Q33 is a polyQ tract size seen in SCA6 (77), we believe that this finding supports the role of the free α1ACTQn in the pathogenesis of SCA6. Further work is necessary in this model to determine whether $\alpha 1ACT_{SCA6}$ acts pathologically through the same genes modulated by $\alpha 1ACT_{WT}$, and to define the electrophysiogical changes that accompany the clinical and pathological abnormalities. However, although these mice demonstrate the pathogenicity of the SCA6-sized $\alpha 1ACT$ in vivo, and provide a model of early cerebellar disease due to an SCA6 disease allele, they are an incomplete model for two reasons: (1) They only express the transgene in Purkinje cells and (2) They do not contain the CACNA1A IRES, as they were made at a time when we believed that the $\alpha 1ACT$ fragment was generated by proteolytic cleavage. Thus, a more accurate model should employ the IRES-generated $\alpha 1ACT$ expressed using the CACNA1A promoter.

We will use a conditional transgenic system, based on the CACNA1A IRES and the CACNA1A gene in a tet-off system to test these questions. We have already shown that insertion of termination codons in the coding sequence 5' to the $\alpha 1ACT$ start site does not impair the translation of $\alpha 1ACT$ from full length $\alpha 1A$ transcripts expressed transfected cells, as evidence of the CACNA1A IRES (FIG. 15). Therefore, we will generate new transgenic mice that express the full region of the functionally-mapped IRES of the $\alpha 1A$ mRNA (from Met1384) with a stop codon inserted at position 1847, 5' to the $\alpha 1ACT$ start for either the Q4 and Q33 repeats ($\alpha 1APstopCT_{WT/SCA6}$), under the control of the tetracycline-responsive element (TRE). Transcripts from this transgene will only generate $\alpha 1ACT_{WT}$ or $\alpha 1ACT_{SCA6}$ protein if the IRES functions in vivo. Second, because the CACNA1A 5' UTR gene regions have been effective driving reporter genes in transgenic mice in an endogenous expression pattern (78), we will generate CACNA1A-tTA mice to breed with the TRE-$\alpha 1APstopCT$ WT/SCA6 lines to establish mice expressing $\alpha 1ACT_{WT}$/or $\alpha 1ACT_{SCA6}$ in the pattern of the CACNA1A gene. The tet-off system will enable doxycycline suppression of $\alpha 1ACT$ expression. In addition to CACNA1A$^{-/-}$ ($\alpha 1A^{-/-}$), we will also breed these $\alpha 1ACT_{WT}$-expressing mice with leaner mice CACNA1A$^{la/la}$ ($\alpha 1A^{la/la}$). Breeding with this CACNA1A mutant is the ideal experiment to test the modular nature of the CACNA1A gene products. The leaner mouse CACNA1A mutation affects splicing and deletes the exons encoding the $\alpha 1A$ C-terminus and $\alpha 1ACT$ protein (79, 80) without affecting channel structure. These mice are less severely affected than $\alpha 1A^{-/-}$ mice and often survive to adulthood if supported past weaning (81, 82). We hypothesize that expression of the $\alpha 1ACT_{WT}$ transgene in $\alpha 1A^{la/la}$ mice will correct neurological function more completely than in the complete knockout, $\alpha 1A^{-/-}$ mice.

General Procedure and Design

The construct, $\alpha 1APstopQ11$ (FIG. 15A) that allows expression of the 75 kD $\alpha 1ACT_{Q11}$ despite the presence of a stop codon at position P1847 is used. Expression levels of these proteins are easily detected based on the 3×FLAG C-terminal epitope tag. We will revise the allele size of $\alpha 1APstopQ11$ to Q4 and Q33, the smallest and largest polyQ repeats recorded in humans, and confirm the continued expression of $\alpha 1ACT_{Q4/33}$ of the correct sizes by transfection into HEK293 cells and western blotting. Subsequently, we will insert these constructs into the pTRE vector and confirm the continued expression in our HEK293 cell line stably expressing tTA. We will generate transgenic mice with the TRE-$\alpha 1APstopCT_{Q4/33}$ constructs. For efficiency we will use donor eggs from Pcp2-tTA mice, (bred in the laboratory), to establish and characterize lines more quickly. We will identify mice with matched levels of Q4 and Q33 transgene expression by western blotting and use backcrosses with the background line (FVB) to confirm single site integration. This initial double transgenic line and expression study will allow prompt testing of hypothesis 1. The CACNA1A IRES mediates endogenous expression of $\alpha 1ACT$. Finally, to assemble the CACNA1A-tTA minigene we will employ a 1.5 kb region 5' to the coding region of the mouse CACNA1A gene, shown previously to yield correct expression (78). These mice will be bred with the TRE-$\alpha 1APstopCT_{Q4/33}$ mice and offspring genotyped to identify those bearing CACNA1A-tTA and the $\alpha 1APstopCT$ transgenes and not the Pcp2-tTA transgenes. We will then have two sets of new transgenic mice expressing either $\alpha 1APstopCT_{Q4}$ or $\alpha 1APstopCT_{SCA6}$ transgenes under the control of either the Pcp2 promoter or the CACNA1A promoter.

Characterization of New $\alpha 1ACT$ Mouse Lines.

We have extensive experience with the generation and characterization of transgenic mouse models of several muscle and cerebellar diseases (83-92). In mice co-expressing Pcp2-tTA or CACNA1A-tTA, $\alpha 1APstopCT_{SCA6}$ mice and $\alpha 1APstopCT_{WT}$ mice, with matched expression levels, will be compared on a normal CACNA1A background at 1, 3, 6, 9, 12, 18 and 24 months of age. In addition, CACNA/A-tTA/$\alpha 1APstopCT_{WT}$ double transgenic mice will be bred with $\alpha 1A^{+/-}$ mice and $\alpha 1A^{+/la}$ to determine whether this transgene, expressed more broadly than Purkinje cells alone, can better rescue the $\alpha 1A^{-/-}$ and $\alpha 1A^{la/la}$ phenotypes. The motor behavior, pathology, electrophysiological changes and gene expression studies of these mice will be compared. After full characterization of these lines we will confirm the impact of and recovery from $\alpha 1ACT_{SCA6}$ expression by suppression using doxycycline (67). All animal procedures are in accordance with the guidelines of our Institutional Animal Care and Use Committee.

Behavioral Characterization.

For phenotyping, mice are observed at monthly intervals for changes in home cage behavior. Mice are characterized using the Digigait Gait Analysis system, a video-based treadmill, in the University of Chicago Mouse Motor Behavior Core, which has been used extensively (90, 9294). The Digigait utilizes a high speed, high-resolution camera to image the walking mouse ventral view on a motorized transparent treadmill belt. It enables efficient comparison of multiple locomotor parameters, such as paw angle, paw area variability, and stride length and width. The measurements are highly reproducible and sensitive to change, thus amenable to comparison of multiple genetically distinct groups or for studying the effects of treatments. Several of these parameters, including paw area variability, and the stride width, length and frequency variability provide a reproducible and consistent change in the $\alpha 1ACTSCA6$ mice (FIG. 20).

Pathological Studies.

Five μm serial, sagittal paraffin sections are used for immunofluorescence studies (95). For antigen retrieval, sections are incubated in 0.05M borate buffer (pH 8.0), 100° C. for 40 minutes (96). Purkinje cells are labeled with anti-calbindin antibody, and parallel (PF) and climbing (CF) fibers with anti-vGlut1 and vGlut2 antibodies and detected with fluorescent second antibody. A TCS laser scanning confocal fluorescence microscope (SP2, Leica) in the UC microscopy core is used to acquire 0.5 μm optical z-axis sections. This technique is particularly valuable for the SCA6 model, as it helps identify dendritic and somatic pathology of Purkinje cells, and gives quantifiable measures of the afferent innervation. To quantitate the degree of cerebellar pathology, atrophy and dendritic shrinkage the thickness of molecular layer (primary fissure) is measured in sections stained for calbindin, the ratio of CF height to molecular layer thickness, and the density of CF and PF innervation on confocal images analyzed using image J (NIH image software) (97).

Electrophysiological Studies.

Synaptic inputs in cerebellar slice preparations are characterized in detail, the amplitude and kinetics of evoked excitatory postsynaptic currents (EPSCs) at PF Purkinje cell synapses are measured, and mini EPSC amplitudes and frequencies at these synapses are recorded (98). Synaptic responses to CF activation (complex spikes in current-clamp and EPSCs in voltage-clamp) are characterized and the elimination of surplus CFs during development is monitored. Finally, the intrinsic excitability of Purkinje cells is determined by establishing the current input spike output relationship. Briefly, sagittal slices of the cerebellar vermis (250 µm) are prepared with a vibratome (Leica VT1000S) using ceramic blades, from mice (various ages; focus on P17-35) after decapitation and isofluorane anesthesia. The slices are allowed to recover for at least 1 h, in artificial CSF (ACSF) containing (in mM): 124 NaCl, 5 KCl, 1.25 $Na_2HPO_4$, 2 $MgSO_4$, 2 $CaCl_2$, 26 $NaHCO_3$, and 10 D-glucose, bubbled with 95% O2 and 5% CO2, and then transferred to a submerged recording chamber superfused with ACSF (34-35° C.). Whole-cell patch-clamp recordings are performed under visual control using DIC optics and a 40× water-immersion objective mounted on a Zeiss Axioskop 2FS microscope. Patch pipettes (3-4 MΩ) are filled with internal saline containing (in mM): 9 KCl, 10 KOH, 120 K-gluconate, 3.48 $MgCl_2$, 10 HEPES, 4 NaCl, 4 $Na_2ATP$, 0.4 $Na_3GTP$, and 17.5 sucrose, pH adjusted to 7.25. For CF-EPSC recordings, a cesium gluconate-based internal saline (in mM): 128 CsOH, 111 gluconic acid, 4 NaOH, 10 CsCl, 2 $MgCl_2$, 10 HEPES, 4 $Na_2ATP$, 0.4 $Na_3GTP$, and 30 sucrose (pH 7.25) is used. A hyperpolarizing bias current is applied to prevent spontaneous spike activity. For stimulation glass pipettes filled with ACSF are placed in the ML for PF and the granule cell layer for CF. Input resistance (Ri) is measured by injection of hyperpolarizing test currents (200 pA; 100 ms) and calculated from the voltage transient toward the end of current injection (98).

Gene Expression Studies.

Based on our gene expression findings in the studies described above, we will isolate total cerebellar RNA and Purkinje cell RNA by LCM, as above, and perform quantitative RT-PCR as in FIG. 17 to measure the expression levels of the genes involved in the pathways affected by the SCA6 mutation. We will also repeat the RNA-seq studies and compare with the results from the Pcp2/α1ACT mice and the human SCA6 cerebellar RNA to determine whether there are additional genes altered with the more robust phenotype that are common with the human disease.

Based on our extensive expression studies with these vectors in cultured cells we anticipate that the α1ACT transcript with the stop codon, α1APstopCT$_{Q4/33}$, will yield identical levels of expression under control of the Pcp2-promoter. We also expect comparable to higher levels with the CACNA1A-tTA driver, based on the broader expression pattern of this gene than Pcp2. We expect that the α1APstopCT$_{WT}$ mice will have quantitative rather than qualitative differences in cerebellar pathology, from the α1ACT$_{SCA6}$ mice, which showed molecular layer (ML) thinning at 2 years (FIG. 20). Specifically, as the disease SCA6 is a late onset cerebellar cortical degeneration, we expect only ML thinning at later ages, rather than Purkinje cell degeneration, similar to early stages of SCA1 mice (97). ML thinning develops between 12 and 15 weeks in SCA1 mice (a more severe SCA) and was seen in homozygous SCA3 mice, both prior to Purkinje cell loss (97, 99). SCA1 mice showed reduced Purkinje cell firing rate and a reduction in the efficiency of the main glutamatergic synapse onto Purkinje cells as measured by PF EPSCs before ataxia (100). In SCA3 knockin mice, Purkinje cells have increased intrinsic excitability, depolarization block and reduced repetitive firing (99). EPSCs recorded in slices may indicate either signs of degeneration, with reduced amplitudes, or compensation with temporal dispersion of PF- or CF-evoked responses after reinnervation. We expect similar changes in gene expression, possibly identifying a pathway more closely associated with changes in SCA6 brains using this genetic strategy.

Identification of IRES-Directed Molecules that Selectively Suppress α1ACT Translation, but not α1A Subunit Expression We have used a Renilla (R-Luc)/firefly (F-Luc) luciferase bicistronic reporter assay to show that the CACNA1A mRNA contains an IRES within a 1014 nucleotide region in the C terminus. The IRES leads to expression of α1ACT, which bears the polyQ tract. This very efficient reporter assay, which ratios the expression levels of F-Luc and R-Luc, is an ideal tool to confirm the optimal IRES sequence, and subsequently to carry out a high throughput screening assay. We seek to identify compounds that inhibit the function of this cellular CACNA1A IRES. We expect to identify additional compounds that interfere with the production of α1ACT, without affecting channel function to that may be potential therapies for SCA6.

Activity of cellular IRES s, including the CACNA1A IRES, varies between cell lines, presumably reflecting differences in the expression of IRES-trans-acting factors (101, 102). To investigate the regulated process of α1ACT protein synthesis, we will predict the secondary structure of CACNA1A IRES using MFOLD and identify the optimal activity IRES element using pRF bicistronic vector. Subsequently, we will isolate ITAFS by "pull down" using biotin-labeled CACNA1A IRES RNA probes and streptavidin paramagnetic beads, identify them by LC-MS/MS, and verify using EMSA. Drugs designed to specifically target ITAFs might provide a therapeutic strategy. Clarifying the secondary structure of CACNA1A IRES and ITAFs will also provide the evidence for small compound screening in the second part of this study described below.

Selective suppression of α1ACT while sparing the α1A channel subunit will be clearly better tolerated than silencing the entire α1A $Ca^{2+}$ channel gene, and the viability of adult α1A/A$^{la/la}$ (leaner) mice indicates it will be tolerated. Thus, in the second part of this study described below we will develop a high throughput system to identify compounds that can inhibit the activity of CACNA1A IRES, as optimized earlier in this study. We will use HEK293 cells and 384-well plate-based transfection system to screen for potential small-molecule inhibitors that block CACNA1A IRES F-Luc/R-Luc activity ratio. We will optimize the assay by titration of cell density and DMSO concentration, well-to-well, plate-to-plate variation and the Z' factor to arrive the maximal signal-to-noise ratio for the high throughput platform. We will use two compound libraries available in the UC Cellular Screening Center, the Prestwick Chemical Library, which contains 1,120 small molecules and Chem Bridge Express-pick small molecule library of 50,000 molecules, as well as custom design anti-sense oligos. For hit compounds that reduce the F-Luc/R-Luc ratio lower than 50% of pRCTF, we will perform counter screening to eliminate non-specific inhibitors of luciferase enzyme activity by using our PC12 cell lines stably over-expressing the epitope-tagged α1ACT$_{WT}$ and α1ACT$_{SCA6}$ subunits.

Identify the Minimal Active Element and ITAFs

We have used a Renilla/firefly luciferase bicistronic reporter assay to show that the CACNA1A mRNA contains an IRES within a 1014 nucleotide sequence in the C terminus. Transfecting a variety of cell lines with the pRCT1014TF dual luciferase reporter revealed that the F-Luc/R-Luc ratios ranged from 14 to 45, in SY5Y, N2a, PC12, HEK 293 and Cos7, with the highest activity of F-Luc seen in neuronal cell lines, PC12 and SY5Y, 2 to 1.8-fold greater than in HEK293 cells (not shown). This observation suggests that neuron-specific cellular factors influence the activity of the CACNA1A IRES (103). We will perform deletion mapping to identify the minimal active element of CACNA1A IRES to locate the motifs for ITAFs. We will extend the assay of IRES activity by designing primers spanning 2 kb within the CACNA1A mRNA 5' of the α1ACT start site and generating series of DNA fragments for subcloning into the bicistronic vector pRF. These constructs (pRCTF) will be transfected into HEK293 cells and F-Luc/R-Luc luciferase activity ratios compared with pR1014TF (FIG. 15B) to identify the fragment(s) with the highest F-Luc/R-Luc activity ratios. As a confirmatory assay, we will use the FLAG-tagged α1A$_{WT}$ or α1A$_{SCA6}$ cDNA expression vectors bearing the same deletions made for pRCTF. We will transfect these internally-deleted α1A constructs into HEK293 cells and perform immunoblots to compare expression levels of the truncated α1ACT-3FLAG protein. Finally, we will use the optimal CACNA1A IRES RNA sequences, labeled with biotin, as probes (compared with control GAPDH RNA), and incubate with PC12 cell cytoplasmic extracts, to purify RNA-protein complexes using streptavidin paramagnetic beads. After separating proteins by SDS-PAGE, bands unique to the CACNA1A IRES precipitates, but not to the GAPDH RNA will be excised and identified by LG-MS/MS (93).

Development of a High Throughput Assay

The assay is based on R-Luc-F-Luc bicistronic reporter and Dual-Glo Luciferase assay system (Promega). In our preliminary data using transfected HEK293 cells, F-Luc/R-Luc ratio was low with pRF, which lacked the IRES sequence, while there was a 25-fold increase in F-Luc/R-Luc ratio when the CACNA1A IRES was present (pRCTF) (FIG. 15). We have established a transient transfection system in which HEK293 cells can be easily transfected with pRF or pRCTF in 96-well plate and our preliminary data also showed that this assay has maximal signal/noise ratio and excellent Z' factor. We will use the optimized IRES fragment in the pRF luciferase reporter vector identified in this aim (pRCTF), and optimize the transient transfection system in 384-well plates, achieved by titrating the cell density and concentration of two luciferase substrates, and compound incubation time, for sufficient sensitivity to enable the identification of compounds with low potency or efficacy.

In each assay, two positive controls will be included to evaluate reproducibility. First, the HCV IRES fragment generated from a well-studied HCV IRES construct (H77 strain, nts 40-372) (pRHCVF) will be used as one of the positive controls. HCV IRES inhibitors—quinacrine and acriflavine will be positive controls for the inhibition of pRHCVF. Based on our preliminary screening, anisomycin has the potential to inhibit the activity of CACNA1 A IRES pRCTF and will be used as a second positive control. Thus, each 384-well plate will have 366 discrete compounds, six pRHCVF positive controls, three positive pRCTF controls (10 mM anisomycin), and six negative controls (1% DMSO controls) and three wells contain the control vector pRF. To test for inhibition of IRES function, after 24 hrs transfected cells will be cultured with candidate small molecule inhibitors for 10-20 hrs. A pilot screen of Prestwick Chemical Library will be run to validate the pRCTF dual luciferase assay, and followed by Chem Bridge Express-pick small molecule library of 50,000 molecules screening. In parallel, we will design anti-sense oligos to effect steric blockade of downstream translation (Gene tools, Morpholino. R-Luc and F-Luc will be measured by Molecular Devices Analyst GT in the UC Cellular Screening Center. Hit compounds will be defined as those that inhibit pRCTF expression (F-Luc/R-Luc light signal) by 50%.

We have recently demonstrated that deletion of the IRES-containing region of the α1A subunit cDNA (with a C terminal epitope tag) eliminates α1ACT expression seen on immunoblotting, without affecting expression of the full-length α1A subunit (FIG. 15A). This finding will be further used to eliminate non-specific inhibitors of luciferase enzyme activity as a counter screen. In this screen, we will expose the "IRES intact" α1A$_{WT}$- and α1A$_{SCA6}$-expressing PC12 lines to lead IRES-active compounds detected in the primary screen to assay for their effect on selective suppression of α1ACT relative to α1A. Cultures will be scaled up to 2 ml cultures and incubated with each concentration of compound for 20 hrs before harvesting for assay by western blot. We will screen for both a selective effect on α1ACT expression vs α1A full-length expression. For each hit compound from the counter screen, we will subsequently confirm the presence of a dose-responses relationship to validate the effect and effective dose range using pRCTF dual luciferase assay.

We expect 0.5%~1% of compounds will decrease the 50% of pRCTF luciferase activity based on the primary screen (104). The optimal RNA sequences involved in IRES function and its related ITAFs will be identified. Counter screen will exclude the non-specific inhibitor and identify specific inhibitors for α1ACT. The effect of lead compounds identified from this screen on cellular and host function will be further studied in our PC12 cell and mouse models. Using our PC12 cell lines stably over-expressing the epitope-tagged α1ACT and α1ACT$_{SCA6}$ subunits, that show the allele-specific differences in neurite outgrowth, we will test the effectiveness of identified compounds at preserving the neurite outgrowth effect of α1ACT. In subsequent years, compounds identified as effective in this study will be screened for optimal in vivo properties. The screen will be either employed directly in vivo in our mouse models or optimized with respect to affinity, selectivity and physico-chemical properties using medicinal chemistry principles for in vivo use.

Example 4

This example demonstrates an exemplary method of suppressing α1ACT expression.

To confirm the translational basis of α1ACT production in cells and to demonstrate the ability of selectively suppressing α1ACT expression for purposes of medical treatment, a morpholino called M-α1A was designed, made, and tested for the ability to inhibit α1ACT expression. The inhibition of α1ACT expression was tested using a dual luciferase (Firefly and Renilla) assay as follows.

Dual Luciferase (Firefly and Renilla) Assay of Morpholino

HEK293 cells were transfected using FuGENE® 6 transfection reagent following the manufacturer's protocol (Promega, Madison, Wis.). Two vectors, named PRF and PR1000TF, were used for the transfection. Morpholinos were prepared following the protocol provided by Gene-Tools LLC (Philomath, Oreg.), the company that produces and designs morpholinos (Moultin and Yan, 2008; Summerton 2005). After 24 hours of transfection, the cells were exposed to morpholinos. As a control, a standard oligo purchased from Gene-Tools was used. A morpholino specifically designed to bind to the mRNA to a 25 base pair region downstream of the start codon, named M-α1ACT, was used as a translational block for α1ACT. After 36 hours from the start of transfection, the cells were collected and analyzed for Firefly and Renilla expression via a luciferase assay using a luminometer.

Western Blotting of Morpholino

HEK293 cells were transfected by pCDNA3α1A following FuGENE® 6 protocol. Morpholinos were prepared following the protocol provided by Gene-Tools LLC. After 24 hours of transfection, the cells were exposed to morpholinos. As a control, a standard oligo purchased from gene-tools was used. A morpholino specifically designed to bind to the mRNA to a 25 base pair region downstream of the start codon, named M-α1A, was used as a translational block for α1ACT. After 36 hours from the start of transfection, the cells were collected and analyzed by western blotting.

Figure 22A:
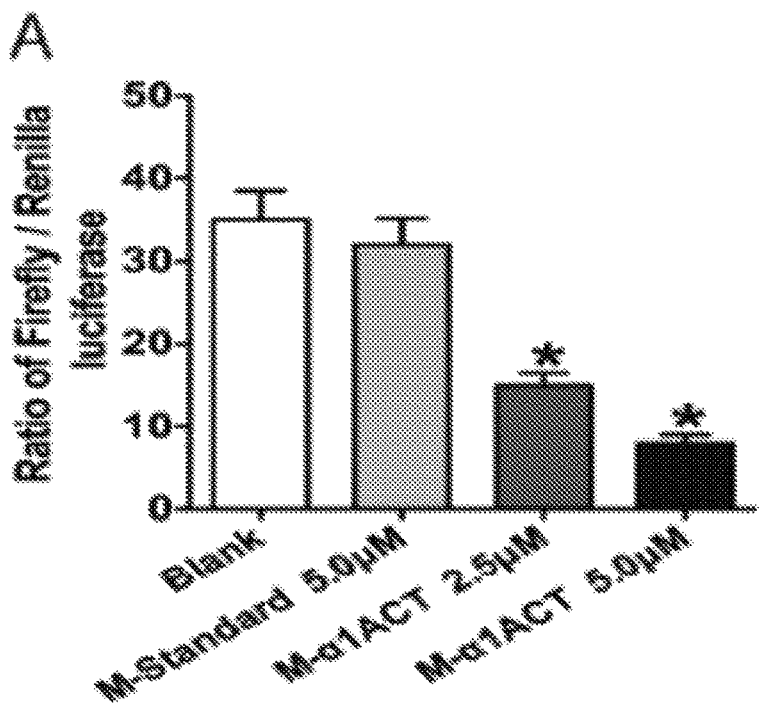
FIG. 22 Morpholino, M-α1A, suppresses expression of α1ACT. The underlined sequence, tcacacctca caagtcc[acggacctcaccgtggggaagatct]acgcagcc atg(atg)atca tggagtacta ccggcaga (SEQ ID NO: 7) of the α1A mRNA was used to design M-α1A. A. Incubation of cells in M-α1A blocked luciferase activity of the bi-cistronic reporter. B. M-α1A blocked formation of α1ACT without affecting α1A.
Figure 22B:
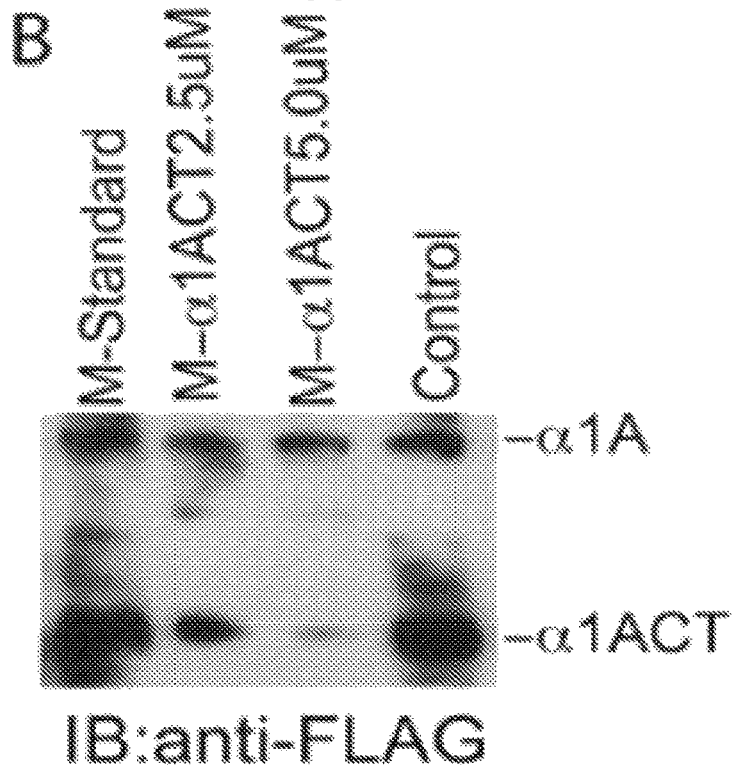

The results of the luciferase assay are shown in FIG. 22A, while the results of the Western blot are shown in FIG. 22B. As shown in FIG. 22A, the exposure of cells to the M-α1ACT morpholino blocked translation through the IRES, as demonstrated by the reduced ratio of firefly to renilla luciferase activity in the bicistronic reporter assay. As shown in FIG. 22B, exposure to the M-α1ACT morpholino also reduced levels of α1ACT protein without affecting levels of α1A.

The same experiments outlined above are carried out for a different morpholino named $M_2$-α1ACT. This morpholino has the sequence GCCGGTAGTACTCCATGATCA (SEQ ID NO: 55) and targets the bracketed sequence of: atg(a[tg) atca tggagtacta ccggc]aga (SEQ ID NO: 56). The bracketed sequence tgatca tggagtacta ccggc is provided herein as SEQ ID NO: 57.

Example 5

This example describes a study involving miRNAs that target different regions of the CACNA1A mRNA.

Figure 23A:
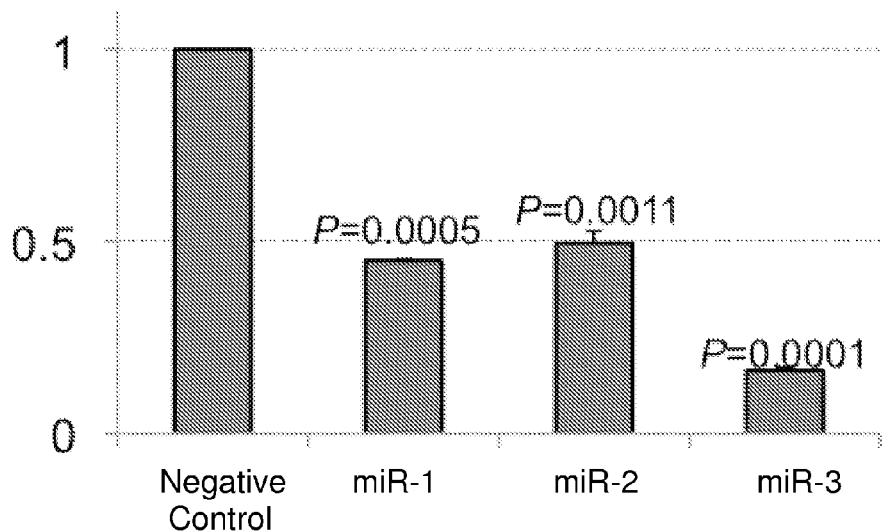
FIG. 23A represents a graph of luciferase activity induced in cells treated with miR-1, miR-2, miR-3, or a negative control.
Figure 23B:
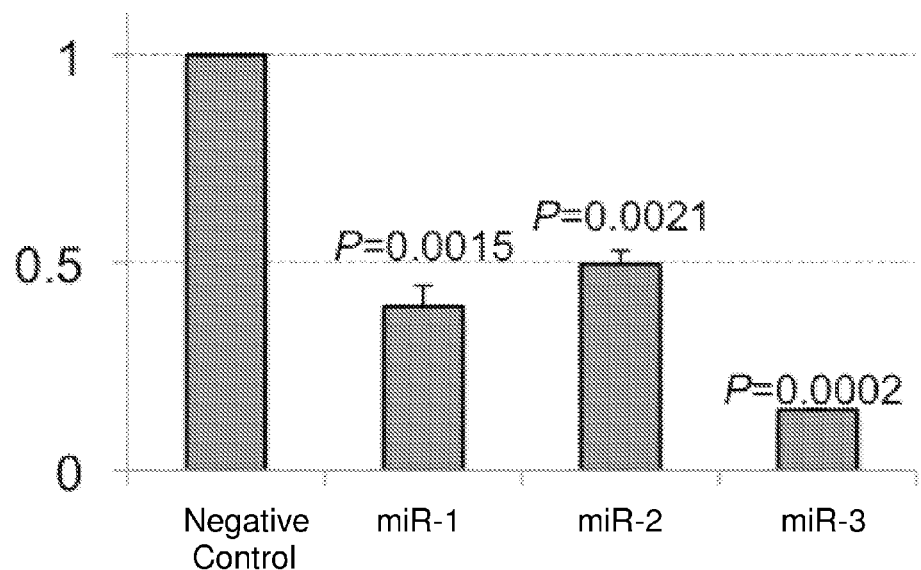
FIG. 23B represents a graph of the level of CACNA1A mRNA in cells treated with miR-1, miR-2, miR-3, or a negative control. n=3, all data are means+s.e.m.

The effects of three miRNAs (miR-1, miR-2, miR-3) on CACNA1A IRES driven translation and on CACNA1A mRNA expression levels were examined by luciferase assay and quantitative RT-PCR analysis, respectively. The miRNAs were predicted to target the sequences within the IRES region. As shown in FIG. 23A, each of the three miRNAs signficantly decreased the IRES-driven translation. As shown in FIG. 23B, each of the three miRNAs also reduced the expression levels of CACNA1A mRNA. It is expected that anti-sense oligonucleotides, including chemically modified anti-sense oligonucleotides, that target the IRES region of CACNA1A will be effective in selectively inhibiting the expression of α1ACT relative to expression of CACNA1A. Accordingly, anti-sense oligonculeotides are contemplated as therapeutics useful in treating SCA6.

Example 6

This example demonstrates that deletion of CACNA1A IRES blocks α1ACT effects.

Figure 24A:
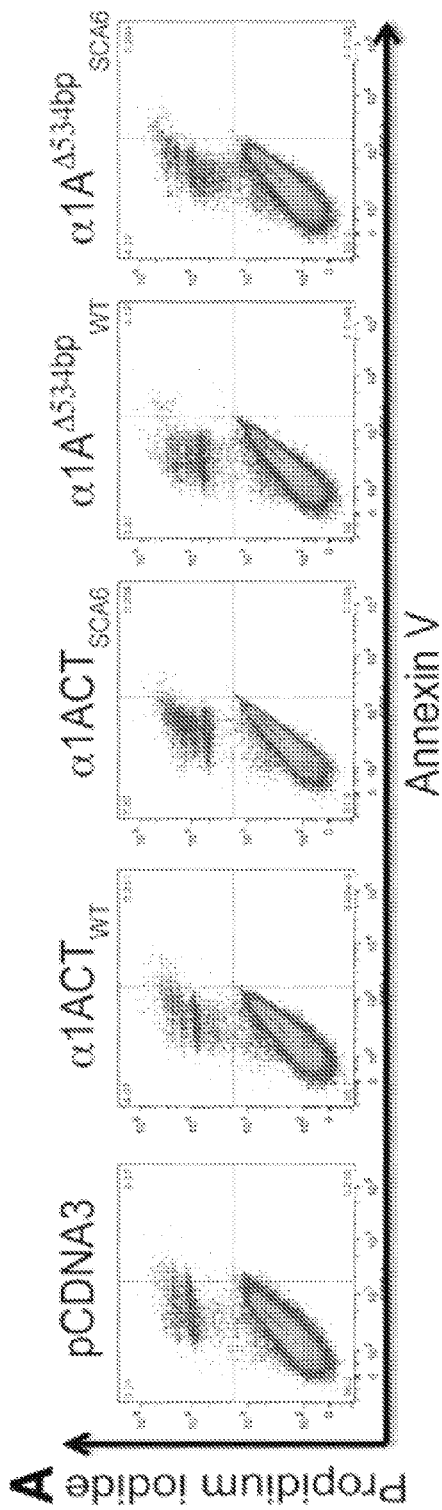
FIG. 24A is a set of graphs demonstrating the staining level of propidium iodide (which marks dead or dying cells with comprised membranes) and annexin V (apoptotic cells) of cells transfected with pCDNA3, α1ACT$_{WT}$, α1ACT$_{SCA6}$, α1ACT$^{\Delta 534b}$$_{WT}$, or α1ACT$^{\Delta 534bp}$$_{SCA6}$.
Figure 24B:
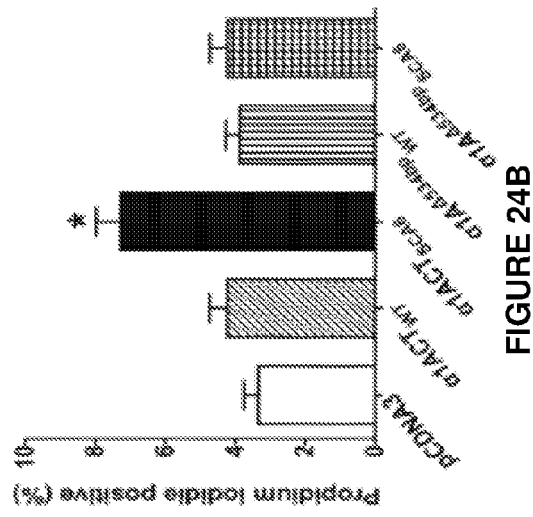
FIG. 24B is a graph of demonstrating the % cells positive for propidium iodide staining of cells transfected with pCDNA3, α1ACT$_{WT}$, α1ACT$_{SCA6}$, α1ACT$^{\Delta 534bp}$$_{WT}$, or α1ACT$^{\Delta 534bp}$$_{SCA6}$.
Figure 24C:
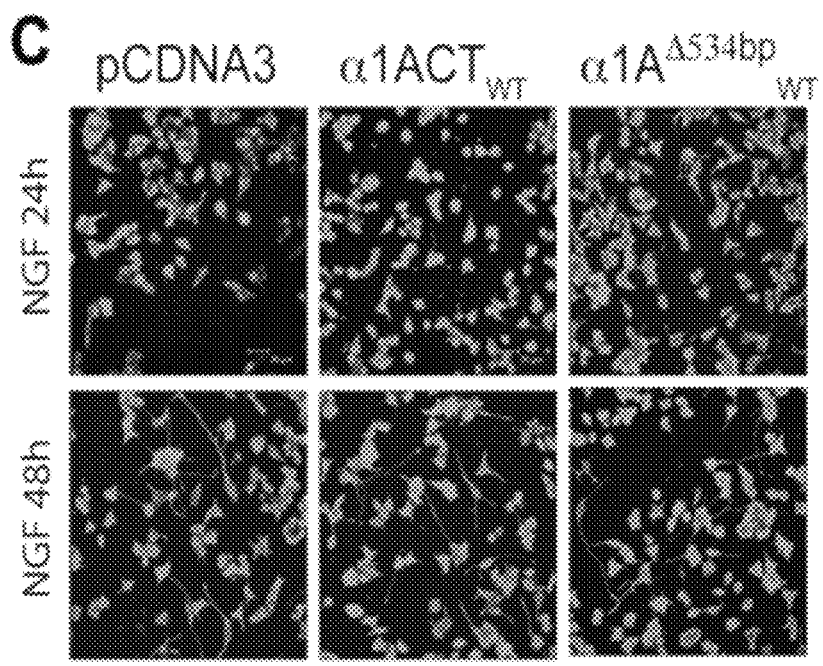
FIG. 24C is a set of images depicting neurite length at 24 hours or 48 hours of cells transfected with pCDNA3, α1ACT$_{WT}$, or α1ACT$^{\Delta 534bp}$$_{WT}$.
Figure 24D:
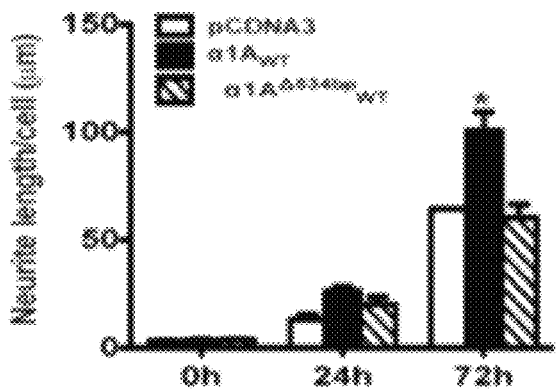
FIG. 24D is a graph demonstrating neurite length/cell (μm) as a function of time of cells transfected with pCDNA3, α1ACT$_{WT}$, or α1ACT$^{A534bp}$$_{WT}$.
Figure 24E:
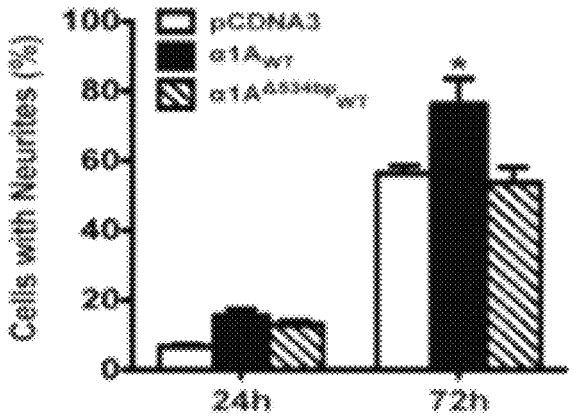
FIG. 24E is a graph demonstrating the % of cells with neurites at 24 h or 72 h of cells transfected with pCDNA3, α1ACT$_{WT}$, or α1ACT$^{A534bp}$$_{WT}$.

A stably transformed cell line in which 534 nucleotides of the CACNA1A IRES was deleted was made in order to confirm the role of the IRES in the biological and pathological effects attributed to α1ACT. Cells transfected with pCDNA3, α1ACT$_{WT}$, α1ACT$_{SCA6}$, α1ACT$^{\Delta 534bp}{}_{WT}$, or α1ACT$^{\Delta 534bp}{}_{SCA6}$ were stained with annexin V or propidium iodide to identify apoptotic cells and dead/dying cells, respectively. As shown in FIGS. 24A and B, the deletion of the 534 nt sequence of the CACNA1A IRES from the full length pathogenic α1A$_{SCA6}$ reduces toxicity. This is consistent with translation through the IRES being responsible for cell toxicity. Cells transfected with pCDNA3, α1ACT$_{WT}$ or α1ACT$^{\Delta 534bp}{}_{WT}$ were assayed for neurite length. As shown in FIGS. 24C-E, cells with the deletion exhibited a reduced neurite length and reduced number of cells containing neurites, relative to the cells with the full length IRES. These data support that the CACNA1A IRES is required for cell toxicity of α1A$_{SCA6}$ and the neurite outgrowth effect of α1A$_{WT}$.

Example 7

Figure 25C:
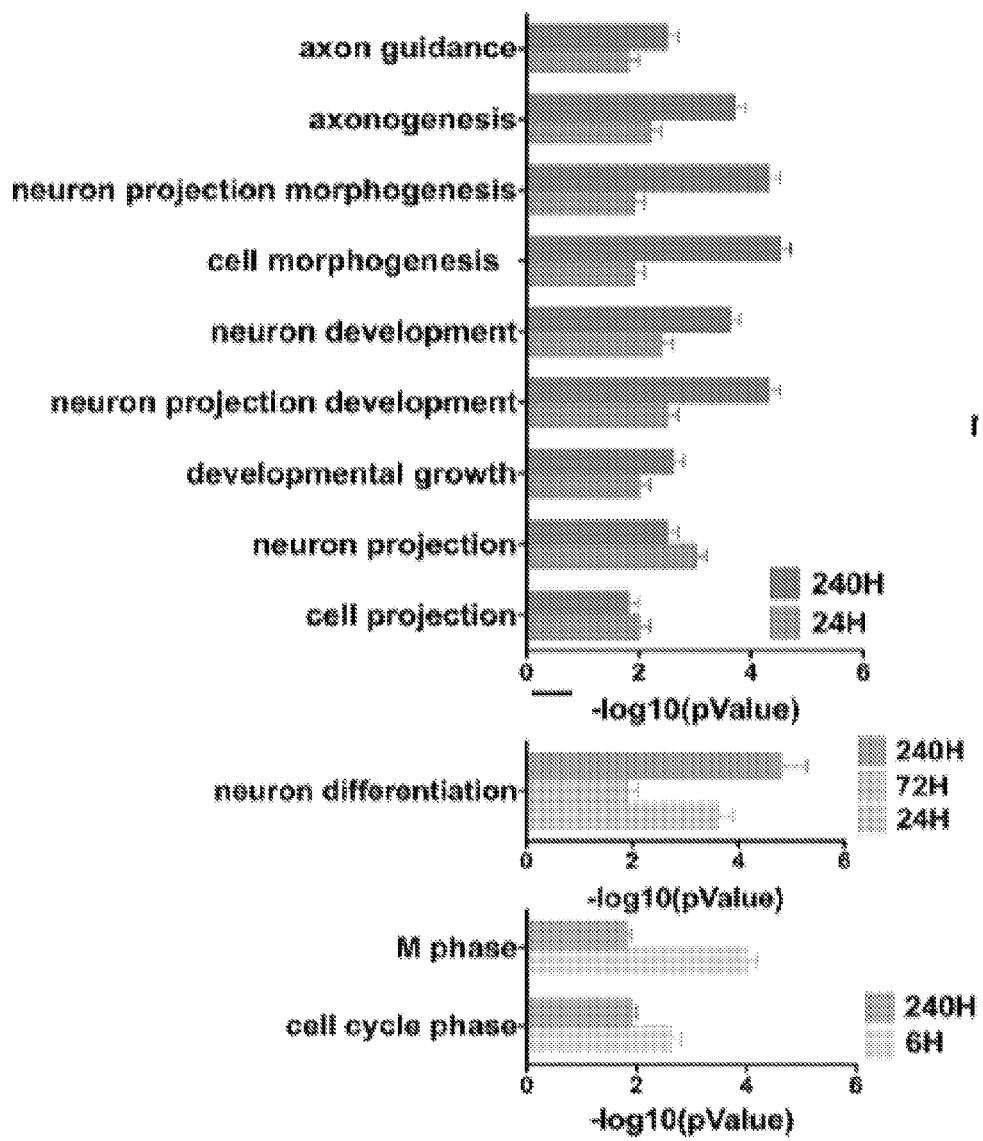
FIG. 25C is a graph of the gene ontology (GO) term enrichment analysis for biology process of α1ACT$_{WT}$ and α1ACT$_{SCA6}$ regulated genes.
Figure 25D:
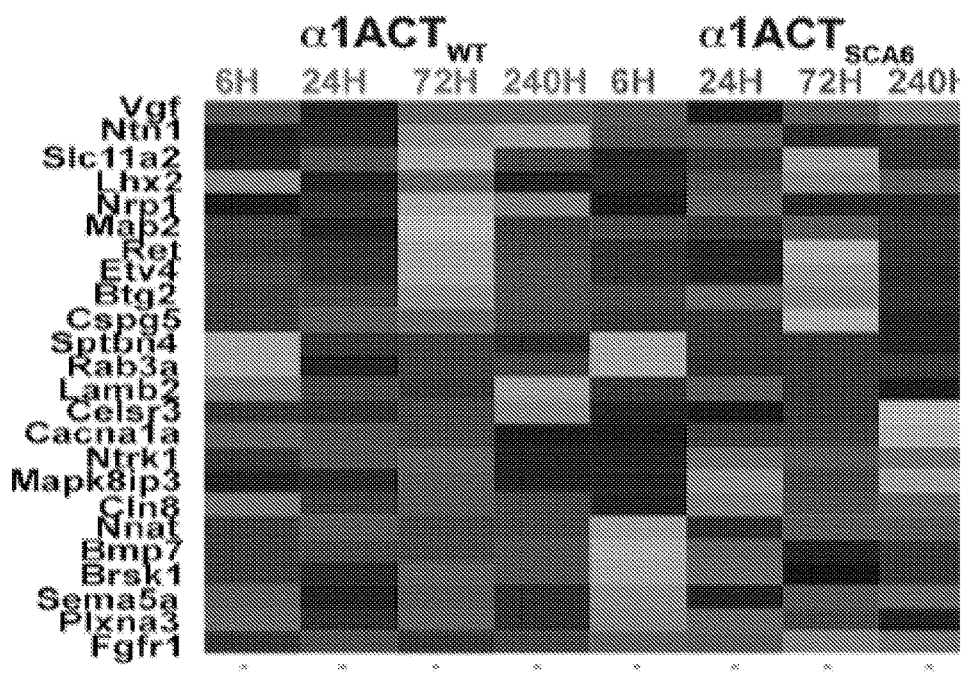
FIGS. 25D and 25E are heatmaps demonstrating temporal expression patterns of genes involved in neuronal differentiation and cell cycle, respectively. N=3, P<0.05.
Figure 25E:
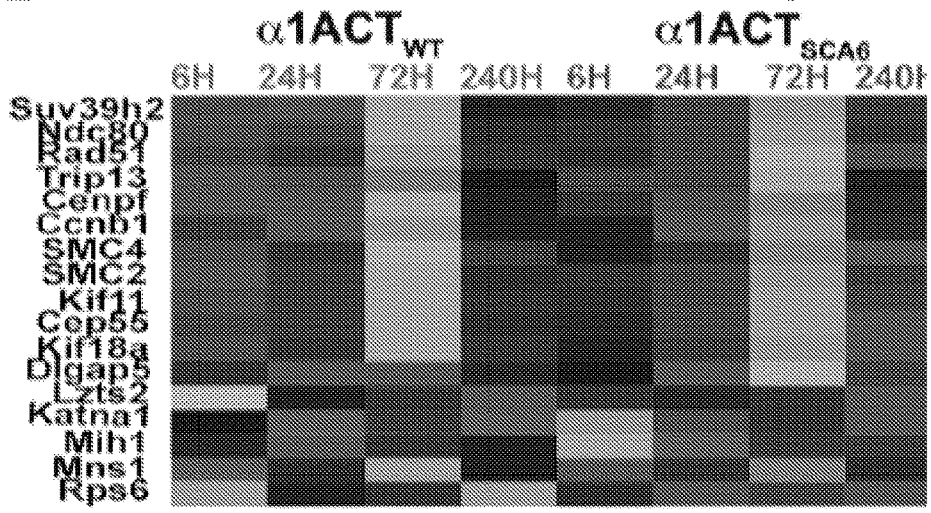

This example demonstrates that α1ACT$_{WT}$ and α1ACT$_{SCA6}$ lead to different gene expression profiles that are involved in a neurogenesis, cell cycle, and cell death pathway.

α1ACT$_{WT}$ as a transcription factor augments PC12 cell neurite outgrowth and binds and enhances expression of a set of Purkinje cell genes. The α1ACT$_{SCA6}$ severely blunts neurite outgrowth, loses the effect on Purkinje cell genes, and causes impaired gait and cerebellar cortical atrophy in vivo. Thus α1ACT$_{SCA6}$ may cause SCA6 by its effect on key transcript levels. To test the hypothesis that the α1ACT$_{SCA6}$ leads to different binding profiles and target gene expression profiles than wild-type, RNA-Seq analysis was performed using PC12 cells expressing α1ACT$_{WT}$, α1ACT$_{SCA6}$, or pCDNA3 at 6 hours, 24 hours, 72 hours, or 240 hours after plating. At each time point, differentially expressed genes (DEGs) were identified between wild-type- and SCA6-transfected cells. Expression levels of thirty-seven genes differed at all 4 time points and had a time-dependent expression pattern (FIGS. 25A, B). Based on the David functional annotation clustering analysis, the DEGs were found to be significantly involved in cell cycle and cell death, development growth, and neurogenesis and were differentially expressed in a time-dependent manner (FIGS. 25C, D). The change of cell cycle DEGs was more significant at the 6-hour time-point. However, the differences in expression between the α1ACT$_{WT}$ and α1ACT$_{SCA6}$ neurogenesis-related DEGs were increased with time.

REFERENCES

The following represents a listing of the references cited in Examples 1 and 2.

Baird, S. D., Turcotte, M., Korneluk, R. G., and Holcik, M. (2006). Searching for IRES. RNA 12, 1755-1785.

Baker, M., Mackenzie, I. R., Pickering-Brown, S. M., Gass, J., Rademakers, R., Lindholm, C., Snowden, J., Adamson, J., Sadovnick, A. D., Rollinson, S., et al. (2006). Mutations in progranulin cause tau-negative frontotemporal dementia linked to chromosome 17. Nature 442, 916-919.

Berthet, C., Guehenneux, F., Revol, V., Samarut, C., Lukaszewicz, A., Dehay, C., Dumontet, C., Magaud, J. P., and Rouault, J. P. (2002). Interaction of PRMT1 with BTG/TOB proteins in cell signalling: molecular analysis and functional aspects. Genes to cells: devoted to molecular & cellular mechanisms 7, 29-39.

Cain, S. M., and Snutch, T. P. (2011). Voltage-gated calcium channels and disease. Biofactors 37, 197-205.

Catterall, W. A. (2011). Voltage-gated calcium channels. Cold Spring Harbor perspectives in biology 3, a003947.

Cimato, T. R., Ettinger, M. J., Zhou, X., and Aletta, J. M. (1997). Nerve growth factor-specific regulation of protein methylation during neuronal differentiation of PC12 cells. The Journal of cell biology 138, 1089-1103.

Coldwell, M. J., deSchoolmeester, M. L., Fraser, G. A., Pickering, B. M., Packham, G., and Willis, A. E. (2001). The p36 isoform of BAG-1 is translated by internal ribosome entry following heat shock. Oncogene 20, 4095-4100.

Cornelis, S., Bruynooghe, Y., Denecker, G., Van Huffel, S., Tinton, S., and Beyaert, R. (2000). Identification and characterization of a novel cell cycle-regulated internal ribosome entry site. Molecular cell 5, 597-605.

Cruts, M., Gijselinck, I., van der Zee, J., Engelborghs, S., Wils, H., Pirici, D., Rademakers, R., Vandenberghe, R., Dermaut, B., Martin, J. J., et al. (2006). Null mutations in progranulin cause ubiquitin-positive frontotemporal dementia linked to chromosome 17q21. Nature 442, 920-924.

Du, X., Rosenfield, R. L., and Qin, K. (2009). KLF15 Is a transcriptional regulator of the human 17beta-hydroxysteroid dehydrogenase type 5 gene. A potential link between regulation of testosterone production and fat stores in women. The Journal of clinical endocrinology and metabolism 94, 2594-2601.

Fitzgerald, K. D., and Semler, B. L. (2009). Bridging IRES elements in mRNAs to the eukaryotic translation apparatus. Biochimica et biophysica acta 1789, 518-528.

Gomez-Ospina, N., Tsuruta, F., Barreto-Chang, O., Hu, L., and Dolmetsch, R. (2006). The C terminus of the L-type voltage-gated calcium channel Ca(V) 1.2 encodes a transcription factor. Cell 127, 591-606.

Hashimoto, K., and Kano, M. (2005). Postnatal development and synapse elimination of climbing fiber to Purkinje cell projection in the cerebellum. Neuroscience research 53, 221-228.

Hashimoto, K., Tsujita, M., Miyazaki, T., Kitamura, K., Yamazaki, M., Shin, H. S., Watanabe, M., Sakimura, K., and Kano, M. (2011). Postsynaptic P/Q-type Ca2+ channel in Purkinje cell mediates synaptic competition and elimination in developing cerebellum. Proceedings of the NationαlAcademy of Sciences of the United States of America 108, 9987-9992.

Ishiguro, T., Ishikawa, K., Takahashi, M., Obayashi, M., Amino, T., Sato, N., Sakamoto, M., Fujigasaki, H., Tsuruta, F., Dolmetsch, R., et al. (2010). The carboxy-terminal fragment of alpha(1A) calcium channel preferentially aggregates in the cytoplasm of human spinocerebellar ataxia type 6 Purkinje cells. Acta neuropathologica 119, 447-464.

Jun, K., Piedras-Renteria, E. S., Smith, S. M., Wheeler, D. B., Lee, S. B., Lee, T. G., Chin, H., Adams, M. E., Scheller, R. H., Tsien, R. W., et al. (1999). Ablation of P/Q-type Ca(2+) channel currents, altered synaptic transmission, and progressive ataxia in mice lacking the alpha (1A)-subunit. Proceedings of the National Academy of Sciences of the United States of America 96, 15245-15250.

Koopman, G., Reutelingsperger, C. P., Kuijten, G. A., Keehnen, R. M., Pals, S. T., and van Oers, M. H. (1994). Annexin V for flow cytometric detection of phosphatidylserine expression on B cells undergoing apoptosis. Blood 84, 1415-1420.

Kordasiewicz, H. B., Thompson, R. M., Clark, H. B., and Gomez, C. M. (2006). C-termini of P/Q-type Ca2+ channel alpha1A subunits translocate to nuclei and promote polyglutamine-mediated toxicity. Human molecular genetics 15, 1587-1599.

Kozel, P. J., Friedman, R. A., Erway, L. C., Yamoah, E. N., Liu, L. H., Riddle, T., Duffy, J. J., Doetschman, T., Miller, M. L., Cardell, E. L., et al. (1998). Balance and hearing deficits in mice with a null mutation in the gene encoding plasma membrane Ca2+-ATPase isoform 2. The Journal of biological chemistry 273, 18693-18696.

Kubodera, T., Yokota, T., Ohwada, K., Ishikawa, K., Miura, H., Matsuoka, T., and Mizusawa, H. (2003). Proteolytic cleavage and cellular toxicity of the human alpha1A calcium channel in spinocerebellar ataxia type 6. Neuroscience letters 341, 74-78.

Kurnellas, M. P., Lee, A. K., Szczepanowski, K., and Elkabes, S. (2007). Role of plasma membrane calcium ATPase isoform 2 in neuronal function in the cerebellum and spinal cord. Annals of the New York Academy of Sciences 1099, 287-291.

La Spada, A. R., Wilson, E. M., Lubahn, D. B., Harding, A. E., and Fischbeck, K. H. (1991). Androgen receptor gene mutations in X-linked spinal and bulbar muscular atrophy. Nature 352, 77-79.

Liu, S., and Friel, D. D. (2008). Impact of the leaner P/Q-type Ca2+ channel mutation on excitatory synaptic transmission in cerebellar Purkinje cells. The Journal of physiology 586, 4501-4515.

Marqueze-Pouey, B., Martin-Moutot, N., Sakkou-Norton, M., Leveque, C., Ji, Y., Cornet, V., Hsiao, W. L., and Seagar, M. (2008). Toxicity and endocytosis of spinocerebellar ataxia type 6 polyglutamine domains: role of myosin IIb. Traffic 9, 1088-1100.

Matsukawa, H., Wolf, A. M., Matsushita, S., Joho, R. H., and Knopfel, T. (2003). Motor dysfunction and altered synaptic transmission at the parallel fiber-Purkinje cell synapse in mice lacking potassium channels Kv3.1 and Kv3.3. The Journal of neuroscience: the official journal of the Society for Neuroscience 23, 7677-7684.

Matsushita, K., Wakamori, M., Rhyu, I.J., Arii, T., Oda, S., Mori, Y., and Imoto, K. (2002). Bidirectional alterations in cerebellar synaptic transmission of tottering and rolling Ca2+ channel mutant mice. The Journal of neuroscience: the official journal of the Society for Neuroscience 22, 4388-4398.

Mintz, I. M., Sabatini, B. L., and Regehr, W. G. (1995). Calcium control of transmitter release at a cerebellar synapse. Neuron 15, 675-688.

Palhan, V. B., Chen, S., Peng, G. H., Tjernberg, A., Gamper, A. M., Fan, Y., Chait, B. T., La Spada, A. R., and Roeder, R. G. (2005). Polyglutamine-expanded ataxin-7 inhibits STAGA histone acetyltransferase activity to produce retinal degeneration. Proceedings of the National Academy of Sciences of the United States of America 102, 8472-8477.

Palmenberg, A. C., and Sgro, J. Y. (1997). Topological organization of picornaviral genomes: Statistical prediction of RNA structural signals. Semin Virol 8, 231-241.

Rajakulendran, S., Kaski, D., and Hanna, M. G. (2012). Neuronal P/Q-type calcium channel dysfunction in inherited disorders of the CNS. Nature reviews Neurology 8, 86-96.

Rouault, J. P., Samarut, C., Duret, L., Tessa, C., Samarut, J., and Magaud, J. P. (1993). Sequence analysis reveals that the BTG1 anti-proliferative gene is conserved throughout evolution in its coding and 3' non-coding regions. Gene 129, 303-306.

Saegusa, H., Wakamori, M., Matsuda, Y., Wang, J., Mori, Y., Zong, S., and Tanabe, T. (2007). Properties of human Cav2.1 channel with a spinocerebellar ataxia type 6 mutation expressed in Purkinje cells. Molecular and cellular neurosciences 34, 261-270.

Scott, V. E., Felix, R., Arikkath, J., and Campbell, K. P. (1998). Evidence for a 95 kDa short form of the alpha1A subunit associated with the omega-conotoxin MVIIC receptor of the P/Q-type Ca2+ channels. The Journal of neuroscience: the official journal of the Society for Neuroscience 18, 641-647.

Sopher, B. L., Thomas, P. S., Jr., LaFevre-Bernt, M. A., Holm, I. E., Wilke, S. A., Ware, C. B., Jin, L. W., Libby, R. T., Ellerby, L. M., and La Spada, A. R. (2004). Androgen receptor YAC transgenic mice recapitulate SBMA motor neuronopathy and implicate VEGF164 in the motor neuron degeneration. Neuron 41, 687-699.

Spriggs, K. A., Cobbold, L. C., Ridley, S. H., Coldwell, M., Bottley, A., Bushell, M., Willis, A. E., and Siddle, K. (2009). The human insulin receptor mRNA contains a functional internal ribosome entry segment. Nucleic acids research 37, 5881-5893.

Spriggs, K. A., Stoneley, M., Bushell, M., and Willis, A. E. (2008). Re-programming of translation following cell stress allows IRES-mediated translation to predominate. Biology of the cell/under the auspices of the European Cell Biology Organization 100, 27-38.

Stolze, H., Klebe, S., Petersen, G., Raethjen, J., Wenzelburger, R., Witt, K., and Deuschl, G. (2002). Typical features of cerebellar ataxic gait. Journal of neurology, neurosurgery, and psychiatry 73, 310-312.

Ul-Hussain, M., Zoidl, G., Klooster, J., Kamermans, M., and Dermietzel, R. (2008). IRES-mediated translation of the carboxy-terminal domain of the horizontal cell specific connexin Cx55.5 in vivo and in vitro. BMC molecular biology 9, 52.

Van Damme, P., Van Hoecke, A., Lambrechts, D., Vanacker, P., Bogaert, E., van Swieten, J., Carmeliet, P., Van Den Bosch, L., and Robberecht, W. (2008). Progranulin functions as a neurotrophic factor to regulate neurite outgrowth and enhance neuronal survival. The Journal of cell biology 181, 37-41.

Watanabe, M., and Kano, M. (2011). Climbing fiber synapse elimination in cerebellar Purkinje cells. The European journal of neuroscience 34, 1697-1710.

Watase, K., Barrett, C.F., Miyazaki, T., Ishiguro, T., Ishikawa, K., Hu, Y., Unno, T., Sun, Y., Kasai, S., Watanabe, M., et al. (2008). Spinocerebellar ataxia type 6 knockin mice develop a progressive neuronal dysfunction with age-dependent accumulation of mutant CaV2.1 channels. Proceedings of the National Academy of Sciences of the United States of America 105, 11987-11992.

Wilkins, M. R., Gasteiger, E., Bairoch, A., Sanchez, J. C., Williams, K. L., Appel, R. D., and Hochstrasser, D. F. (1999). Protein identification and analysis tools in the ExPASy server. Methods Mol Biol 112, 531-552.

Wilson, J. E., Powell, M. J., Hoover, S. E., and Sarnow, P. (2000). Naturally occurring dicistronic cricket paralysis virus RNA is regulated by two internal ribosome entry sites. Molecular and cellular biology 20, 4990-4999.

Zacharias, D. A., and Kappen, C. (1999). Developmental expression of the four plasma membrane calcium ATPase (Pmca) genes in the mouse. Biochimica et biophysica acta 1428, 397-405.

Zhuchenko, O., Bailey, J., Bonnen, P., Ashizawa, T., Stockton, D. W., Amos, C., Dobyns, W. B., Subramony, S. H., Zoghbi, H. Y., and Lee, C. C. (1997). Autosomal dominant cerebellar ataxia (SCA6) associated with small polyglutamine expansions in the alpha 1A-voltage-dependent calcium channel. Nature genetics 15, 62-69.

Zu, T., Duvick, L. A., Kaytor, M. D., Berlinger, M. S., Zoghbi, H. Y., Clark, H. B., and Orr, H. T. (2004). Recovery from polyglutamine-induced neurodegeneration in conditional SCA1 transgenic mice. The Journal of neuroscience: the official journal of the Society for Neuroscience 24, 8853-8861.

Zucker, R. S., and Regehr, W. G. (2002). Short-term synaptic plasticity. Annual review of physiology 64, 355-405.

Zuker, M. (2003). Mfold web server for nucleic acid folding and hybridization prediction. Nucleic acids research 31, 3406-3415.

Du, X., Rosenfield, R. L., and Qin, K. (2009). KLF15 Is a transcriptional regulator of the human 17beta-hydroxysteroid dehydrogenase type 5 gene. A potential link between regulation of testosterone production and fat sto res in women. The Journal of clinical endocrinology and metabolism 94, 2594-2601.

Jun, K., Piedras-Renteria, E. S., Smith, S. M., Wheeler, D. B., Lee, S. B., Lee, T. G., Chin, H., Adams, M. E., Scheller, R. H., Tsien, R. W., et al. (1999). Ablation of P/Q-type Ca(2+) channel currents, altered synaptic transmission, and progressive ataxia in mice lacking the alpha (1A)-subunit. Proceedings of the Nationak Academy of Sciences of the United States of America 96, 15245-15250.

Kordasiewicz, H. B., Thompson, R. M., Clark, H. B., and Gomez, C. M. (2006). C-termini of P/Q-type Ca2+ channel alphα1A subunits translocate to nuclei and promote polyglutamine-mediated toxicity. Human molecular genetics 15, 1587-1599.

Miyazaki, T., and Watanabe, M. (2011). Development of an anatomical technique for visualizing the mode of climbing fiber innervation in Purkinje cells and its application to mutant mice lacking GluRdelta2 and Ca(v)2.1. Anatomical science international 86, 10-18.

Zu, T., Duvick, L. A., Kaytor, M. D., Berlinger, M. S., Zoghbi, H. Y., Clark, H. B., and Orr, H. T. (2004). Recovery from polyglutamine-induced neurodegeneration in conditional SCA1 transgenic mice. The Journal of neuroscience: the official journal of the Society for Neuroscience 24, 8853-8861.

The following represents a listing of the references cited in Example 3.

1. Moseley M L, Benzow K A, Schut L J, Bird T D, Gomez C M, Barkhaus P E, et al. Incidence of dominant spinocerebellar and Friedreich triplet repeats among 361 ataxia families. Neurology. 1998; 51(6):166671.
2. Wu Y R, Lin H Y, Chen C M, Gwinn-Hardy K, Ro L S, Wang Y C, et al. Genetic testing in spinocerebellar ataxia in Taiwan: expansions of trinucleotide repeats in SCA8 and SCA17 are associated with typical Parkinson's disease. Clin Genet. 2004; 65(3):209-14.
3. Jayadev S, Michelson S, Lipe H, Bird T. Cambodian founder effect for spinocerebellar ataxia type 3 (Machado-Joseph disease). J Neurol Sci. 2006; 250(1-2):110-3.
4. Basri R, Yabe I, Soma H, Sasaki H. Spectrum and prevalence of autosomal dominant spinocerebellar ataxia 5. Klockgether T. The clinical diagnosis of autosomal dominant spinocerebellar ataxias. Cerebellum. 2008; 7(2):101-5.
6. Wardle M, Majounie E, Muzaimi M B, Williams N M, Morris H R, Robertson N P. The genetic aetiology of late-onset chronic progressive cerebellar ataxia. A population-based study. J Neurol. 2009; 256(3):3438.
7. Kurtzke J F. Epidemiology of amyotrophic lateral sclerosis. Adv Neurol. 1982; 36:281-302.
8. Zhuchenko O, Bailey J, Bonnen P, Ashizawa T, Stockton D W, Amos C, et al. Autosomal dominant cerebellar ataxia (SCA6) associated with small polyglutamine expansions in the alpha 1A-voltage-dependent calcium channel. Nature Genetics. 1997; 15(1):62-9.
9. Craig K, Keers S M, Archibald K, Curtis A, Chinnery P F. Molecular epidemiology of spinocerebellar ataxia type 6. Ann Neurol. 2004; 55(5):752-5.
10. Perlman S L. Spinocerebellar degenerations. Handb Clin Neurol. 2011; 100:113-40.
11. Klockgether T. Update on degenerative ataxias. Curr Opin Neurol. 2011; 24(4):339-45.
12. Marelli C, Cazeneuve C, Brice A, Stevanin G, Durr A. Autosomal dominant cerebellar ataxias. Rev Neurol (Paris). 2011; 167(5):385-400.
13. Durr A. Autosomal dominant cerebellar ataxias: polyglutamine expansions and beyond. Lancet Neurol. 2010; 9(9):885-94.
14. Tsuji S, Onodera O, Goto J, Nishizawa M. Sporadic ataxias in Japan—a population-based epidemiological study. Cerebellum. 2008; 7(2):189-97.
15. Lopez-Bastida J, Perestelo-Perez L, Monton-Alvarez F, Serrano-Aguilar P. Social economic costs and health-related quality of life in patients with degenerative cerebellar ataxia in Spain. Mov Disord. 2008; 23(2):212-7.
16. Shao J, Diamond M I. Polyglutamine diseases: emerging concepts in pathogenesis and therapy. Hum Mol Genet. 2007; 16 Spec No. 2:R115-23.
17. Bauer P O, Nukina N. The pathogenic mechanisms of polyglutamine diseases and current therapeutic strategies. J Neurochem. 2009; 110(6):1737-65.
18. La Spada A R, Taylor J P. Repeat expansion disease: progress and puzzles in disease pathogenesis. Nat Rev Genet. 2010; 11(4):247-58.
19. He X H, Lin F, Qin Z H. Current understanding on the pathogenesis of polyglutamine diseases. Neurosci Bull. 2010; 26(3):247-56.
20. Gomez C M, Thompson R M, Gammack J T, Perlman S L, Dobyns W B, Truwit C L, et al. Spinocerebellar ataxia type 6: gaze-evoked and vertical nystagmus, Purkinje cell degeneration, and variable age of onset. Ann Neurol. 1997; 42(6):933-50.
21. Koeppen A H. The hereditary ataxias. [Review] [74 refs]. Journal of Neuropathology & Experimental Neurology. 1998; 57(6):531-43.
22. Havel L S, Li S, Li X J. Nuclear accumulation of polyglutamine disease proteins and neuropathology. Mol Brain. 2009; 2:21.
23. Pula J H, Towle V L, Staszak V M, Cao D, Bernard J T, Gomez C M. Retinal Nerve Fibre Layer and Macular Thinning in Spinocerebellar Ataxia and Cerebellar Multisystem Atrophy. Neuroophthalmology. 2011; 35(3):108-14.
24. Elden A C, Kim H J, Hart M P, Chen-Plotkin A S, Johnson B S, Fang X, et al. Ataxin-2 intermediate-length polyglutamine expansions are associated with increased risk for ALS. Nature. 2010; 466(7310):1069-75.
25. Yalcin O. Genes and molecular mechanisms involved in the epileptogenesis of idiopathic absence epilepsies. Seizure. 2011.
26. Rajakulendran S, Kaski D, Hanna M G. Neuronal P/Q-type calcium channel dysfunction in inherited disorders of the CNS. Nat Rev Neurol. 2012.
27. Jen J, G. W. Kim G W, R. W. Baloh R W. Clinical spectrum of episodic ataxia type 2. Neurology. 2004; 62:17-22.
28. Spacey S D, Materek L A, Szczygielski B I, Bird T D. Two novel CACNA1A gene mutations associated with episodic ataxia type 2 and interictal dystonia. Arch Neurol. 2005; 62(2):314-6.
29. Roubertie A, Echenne B, Leydet J, Soete S, Krams B, Rivier F, et al. Benign paroxysmal tonic upgaze, benign paroxysmal torticollis, episodic ataxia and CACNA1A mutation in a family. J Neurol. 2008; 255(10):1600-2.
30. Kordasiewicz H B, Gomez C M. Molecular pathogenesis of spinocerebellar ataxia type 6. Neurotherapeutics. 2007; 4(2):285-94.
31. Lory P, Mezghrani A. Calcium channelopathies in inherited neurological disorders: relevance to drug screening for acquired channel disorders. IDrugs. 2010; 13(7):467-71.
32. Matsuyama Z, Minoru Wakamori, Mori Y, Kawakami H, Nakamura S, Imoto K. Direct Alteration of the P/Q-Type Ca2+ Channel Property by Polyglutamine Expansion in Spinocerebellar Ataxia 6. J. Neurosci. 1999; RC14:1-5.
33. Restituito S, Thompson R, Charnet P, Gomez C M. The polyglutamine expansion in spinocerebellar ataxia type 6 causes a β subunit-specific enhanced activation of P/Q-type calcium channels in Xenopus oocytes. J. Neurosci. 2000; 20(17):6394-403.
34. Toru S, Murakoshi T, Ishikawa K, Saegusa H, Fujigasaki H, Uchihara T, et al. Spinocerebellar ataxia type 6 mutation alters P-type calcium channel function. Journal of Biological Chemistry. 2000; 275(15):10893-8.
35. Piedras-Renteria E S, Watase K, Harata N, Zhuchenko O, Zoghbi H Y, Lee C C, et al. Increased expression of alpha 1A Ca2+ channel currents arising from expanded trinucleotide repeats in spinocerebellar ataxia type 6. J Neurosci. 2001; 21(23):9185-93.
36. Chen H, Piedras-Renteria E S. Altered frequency-dependent inactivation and steady-state inactivation of polyglutamine-expanded alpha1A in SCA6. Am J Physiol Cell Physiol. 2007; 292(3):C1078-86.
37. Saegusa H, Wakamori M, Matsuda Y, Wang J, Mori Y, Zong S, et al. Properties of human Cav2.1 channel with a spinocerebellar ataxia type 6 mutation expressed in Purkinje cells. Mol Cell Neurosci. 2007; 34(2):261-70.
38. Watase K, Barrett C F, Miyazaki T, Ishiguro T, Ishikawa K, Hu Y, et al. Spinocerebellar ataxia type 6 knockin mice develop a progressive neuronal dysfunction with age-dependent accumulation of mutant CaV2.1 channels. Proc Natl Acad Sci USA. 2008; 105(33):11987-92.
39. Riley B E, Orr H T. Polyglutamine neurodegenerative diseases and regulation of transcription: assembling the puzzle. Genes Dev. 2006; 20(16):2183-92.
40. La Spada A R, Taylor J P. Polyglutamines placed into context. Neuron. 2003; 38(5):681-4.
41. Robertson A L, Bottomley S P. Towards the treatment of polyglutamine diseases: the modulatory role of protein context. Curr Med Chem. 2010; 17(27):3058-68.
42. Matsuyama Z, Kawakami H, Maruyama H, Izumi Y, Komure O, Udaka F, et al. Molecular features of the cag 43. Ishikawa K, Fujigasaki H, Saegusa H, Ohwada K, Fujita T, Iwamoto H, et al. Abundant expression and cytoplasmic aggregations of alpha 1A voltage-dependent calcium channel protein associated with neurodegeneration in spinocerebellar ataxia type 6. Human Molecular Genetics. 1999; 8(7):1185-93.

44. Koeppen A H. The pathogenesis of spinocerebellar ataxia. Cerebellum. 2005; 4(1):62-73.

45. Takahashi T, Katada S, Onodera O. Polyglutamine diseases: where does toxicity come from? what is toxicity? where are we going? J Mol Cell Biol. 2010; 2(4): 180-91.

46. Scott V E, Felix R, Arikkath J, Campbell K P. Evidence for a 95 kDa short form of the alpha1A subunit associated with the omega-conotoxin MVIIC receptor of the P/Q-type Ca2+ channels. J Neurosci. 1998; 18(2):641-7.

47. Kubodera T, Yokota T, Ohwada K, Ishikawa K, Miura H, Matsuoka T, et al. Proteolytic cleavage and cellular toxicity of the human alpha1A calcium channel in spinocerebellar ataxia type 6. Neurosci Lett. 2003; 341(1):74-8.

48. Kordasiewicz H B, Thompson R M, Clark H B, Gomez C M. C-termini of P/Q-type Ca2+ channel alphα1A subunits translocate to nuclei and promote polyglutamine-mediated toxicity. Hum Mol Genet. 2006; 15(10):1587-99.

49. Marqueze-Pouey B, Martin-Moutot N, Sakkou-Norton M, Leveque C, Ji Y, Cornet V, et al. Toxicity and endocytosis of spinocerebellar ataxia type 6 polyglutamine domains: role of myosin IIb. Traffic. 2008; 9(7):1088-100.

50. Ishiguro T, Ishikawa K, Takahashi M, Obayashi M, Amino T, Sato N, et al. The carboxy-terminal fragment of alpha(1A) calcium channel preferentially aggregates in the cytoplasm of human spinocerebellar ataxia type 6 Purkinje cells. Acta Neuropathol. 2010; 119(4):447-64.

51. Hellen C U, Sarnow P. Internal ribosome entry sites in eukaryotic mRNA molecules. Genes Dev. 2001; 15(13): 1593-612.

52. Cornelis S, Bruynooghe Y, Denecker G, Van Huffel S, Tinton S, Beyaert R. Identification and characterization of a novel cell cycle-regulated internal ribosome entry site. Mol Cell. 2000; 5(4):597605.

53. Lauring A S, Overbaugh J. Evidence that an IRES within the Notch2 coding region can direct expression of a nuclear form of the protein. Mol Cell. 2000; 6(4):939-45.

54. Du X L, Wang J, Zhu H, Rinaldo L, Hu Y, Lamar K, Palmenberg A C, Hansel, C, Gomez C. A second cistron in the CACNA1A gene encodes a transcription factor that mediates cerebellar development and SCA6, in preparation.

55. Gomez-Ospina N, Tsuruta F, Barreto-Chang O, Hu L, Dolmetsch R. The C terminus of the L-type voltage-gated calcium channel Ca(V) 1.2 encodes a transcription factor. Cell. 2006; 127(3):591-606.

56. Barbado M, Fablet K, Ronjat M, De Waard M. Gene regulation by voltage-dependent calcium channels. Biochim Biophys Acta. 2009; 1793(6):1096-104.

57. Hibino H, Pironkova R, Onwumere O, Rousset M, Charnet P, Hudspeth A J, et al. Direct interaction with a nuclear protein and regulation of gene silencing by a variant of the Ca2+-channel beta 4 subunit. Proc Natl Acad Sci USA. 2003; 100(1):307-12.

58. Latchman D S. Transcription-factor mutations and disease. N Engl J Med. 1996; 334(1):28-33.

59. Yang Y X, Latchman D S. Nurr1 transcriptionally regulates the expression of alpha-synuclein. Neuroreport. 2008; 19(8):867-71.

60. Egly J M, Coin F. A history of TFIIH: two decades of molecular biology on a pivotal transcription/repair factor. DNA Repair (Amst). 2011; 10(7):714-21.

61. Adkins N L, Georgel P T. MeCP2: structure and function. Biochem Cell Biol. 2011; 89(1):1-11.

62. Shoubridge C, Fullston T, Gecz J. ARX spectrum disorders: making inroads into the molecular pathology. Hum Mutat. 2010; 31(8):889-900.

63. Daniel R, He Z, Carmichael K P, Halper J, Bateman A. Cellular localization of gene expression for progranulin. J Histochem Cytochem. 2000; 48(7):999-1009.

64. Su A I, Wiltshire T, Batalov S, Lapp H, Ching K A, Block D, et al. A gene atlas of the mouse and human protein-encoding transcriptomes. Proc Natl Acad Sci USA. 2004; 101(16):6062-7.

65. Empson R M, Garside M L, Knopfel T. Plasma membrane Ca2+ ATPase 2 contributes to short-term synapse plasticity at the parallel fiber to Purkinje neuron synapse. J Neurosci. 2007; 27(14):3753-8.

66. Li S H, Cheng A L, Li H, Li X J. Cellular defects and altered gene expression in PC12 cells stably expressing mutant huntingtin. J Neurosci. 1999; 19(13):5159-72.

67. Zu T, Duvick L A, Kaytor M D, Berlinger M S, Zoghbi H Y, Clark H B, et al. Recovery from polyglutamine-induced neurodegeneration in conditional SCA1 transgenic mice. J Neurosci. 2004; 24(40):8853-61.

68. Fureman B E, Jinnah H A, Hess E J. Triggers of paroxysmal dyskinesia in the calcium channel mouse mutant tottering. Pharmacol Biochem Behav. 2002; 73(3): 631-7.

69. Weisz C J, Raike R S, Soria-Jasso L E, Hess E J. Potassium channel blockers inhibit the triggers of attacks in the calcium channel mouse mutant tottering. J Neurosci. 2005; 25(16):4141-5.

70. Du X, Rosenfield R L, Qin K. KLF15 Is a transcriptional regulator of the human 17beta-hydroxysteroid dehydrogenase type 5 gene. A potential link between regulation of testosterone production and fat stores in women. J Clin Endocrinol Metab. 2009; 94(7):2594-601.

71. Huang da W, Sherman B T, Lempicki R A. Systematic and integrative analysis of large gene lists using DAVID bioinformatics resources. Nat Protoc. 2009; 4(1):44-57.

72. Pepke S, Wold B, Mortazavi A. Computation for ChIP-seq and RNA-seq studies. Nat Methods. 2009; 6(11 Suppl):522-32.

73. Benn C L, Sun T, Sadri-Vakili G, McFarland K N, DiRocco D P, Yohrling G J, et al. Huntingtin modulates transcription, occupies gene promoters in vivo, and binds directly to DNA in a polyglutamine-dependent manner. J Neurosci. 2008; 28(42):10720-33.

74. Li X, Zhu C, Tu W H, Yang N, Qin H, Sun Z. ZMIZ1 preferably enhances the transcriptional activity of androgen receptor with short polyglutamine tract. PLoS One. 2011; 6(9):e25040.

75. Boy J, Schmidt T, Wolburg H, Mack A, Nuber S, Bottcher M, et al. Reversibility of symptoms in a conditional mouse model of spinocerebellar ataxia type 3. Hum Mol Genet. 2009; 18(22):4282-95.

76. Wang A, Das P, Switzer R C, 3rd, Golde T E, Jankowsky J L. Robust amyloid clearance in a mouse model of Alzheimer's disease provides novel insights into the mechanism of amyloid-beta immunotherapy. J Neurosci. 2011; 31(11):4124-36.

77. Yabe I, Sasaki H, Matsuura T, Takada A, Wakisaka A, Suzuki Y, et al. Sca1 mutation analysis in a large cohort of the japanese patients with late-onset pure cerebellar ataxia. Journal of the Neurological Sciences. 1998; 156(1):89-95.

78. Takahashi E, Ino M, Miyamoto N, Nagasu T. Expression analysis of P/Q-type Ca2+ channel alpha 1A subunit mRNA in olfactory mitral cell in N-type Ca2+ channel alpha 1B subunit gene-deficient mice. Neurosci Lett. 2004; 359(1-2):37-40.

79. Fletcher C F, Lutz C M, O'Sullivan T N, Shaughnessy J J, Hawkes R, Frankel W N, et al. Absence epilepsy in tottering mutant mice is associated with calcium channel defects. Cell. 1996; 87(4):607-17.

80. Lau F C, Abbott L C, Rhyu L T, Kim D S, Chin H. Expression of calcium channel alpha1A mRNA and protein in the leaner mouse (tgla/tgla) cerebellum. Brain Res Mol Brain Res. 1998; 59(1):93-9.

81. Sidman R L, Appel S H, Fullier J F. Neurological Mutants of the Mouse. Science. 1965; 150(3695):513-6.

82. Herrup K, Wilczynski S L. Cerebellar cell degeneration in the leaner mutant mouse. Neuroscience. 1982; 7(9):2185-96.

83. Gomez C M, Bhattacharyya B B, Charnet P, Day J W, Labarca C, Wollmann R W, et al. A transgenic mouse model of the slow-channel syndrome. Muscle and Nerve. 1996; 19:79-87.

84. Gomez C M, Maselli R, Gundeck J E, Chao M, Day J W, Tamamizu S, et al. Slow-channel transgenic mice: a model of postsynaptic organellar degeneration at the neuromuscular junction. Journal of Neuroscience. 1997; 17(11):4170-9.

85. Bhattacharyya B J, Day J, Gundeck J E, Leonard S, Wollmann R W, Gomez C. Desensitization of Mutant Acetylcholine Receptors in Transgenic Mice Reduces the Amplitude of Synaptic Currents. Synapse. 1997; 27(4):367-77.

86. Gomez C, Maselli R, Groshong J G, Zayas R, Wollmann R L, Thierry Cens T, et al. Active Calcium Accumulation Underlies Severe Weakness In A Panel Of Mice With Slow-Channel Syndrome. J. Neuroscience. 2002; 22(15):6447-57.

87. Vohra B P, Groshong J S, Zayas R, Wollmann R L, Gomez C M. Activation of apoptotic pathways at muscle fiber synapses is circumscribed and reversible in a slow-channel syndrome model. Neurobiol Dis. 2006; 23(2):462-70.

88. Groshong J S, Spencer M J, Bhattacharyya B J, Kudryashova E, Vohra B P, Zayas R, et al. Calpain activation impairs neuromuscular transmission in a mouse model of the slow-channel myasthenic syndrome. J Clin Invest. 2007; 117(10):2903-12.

89. Zayas R, Groshong J S, Gomez C M. Inositol-1,4,5-triphosphate receptors mediate activity-induced synaptic Ca2+ signals in muscle fibers and Ca2+ overload in slow-channel syndrome. Cell Calcium. 2007; 41(4):343-52.

90. Zhu H, Bhattacharyya B J, Lin H, Gomez C M. Skeletal muscle IP3R1 receptors amplify physiological and pathological synaptic calcium signals. J Neurosci. 2011; 31(43):15269-83.

91. Zhu H, Gomez C. Further evidence for the role of Ins(1,4,5)P3R1 in regulating subsynaptic gene expression and neuromuscular transmission. Channels. 2012; 6(1):1-4.

92. Traka M, Millen K J, Collins D, Elbaz B, Gomez C M, Popko B. A missense mutation in the cerebellar hypoplasia, mental retardation & quadrupedal locomotion (CAMRQ2) disease protein WDR81 causes Purkinje cell degeneration and photoreceptor cell loss in the mouse. submitted.

93. Amende I, Kale A, McCue S, Glazier S, Morgan J P, Hampton T G. Gait dynamics in mouse models of Parkinson's disease and Huntington's disease. J Neuroeng Rehabil. 2005; 2:20.

94. Li S, Kim J E, Budel S, Hampton T G, Strittmatter S M. Transgenic inhibition of Nogo-66 receptor function allows axonal sprouting and improved locomotion after spinal injury. Mol Cell Neurosci. 2005; 29(1):2639.

95. Sillitoe R V, Hawkes R. Whole-mount immunohistochemistry: a high-throughput screen for patterning defects in the mouse cerebellum. J Histochem Cytochem. 2002; 50(2):235-44.

96. Kim S H, Kook M C, Shin Y K, Park S H, Song H G. Evaluation of antigen retrieval buffer systems. J Mol Histol. 2004; 35(4):409-16.

97. Clark H B, Burright E N, Yunis W S, Larson S, Wilcox C, Hartman B, et al. Purkinje cell expression of a mutant allele of SCA1 in transgenic mice leads to disparate effects on motor behaviors, followed by a progressive cerebellar dysfunction and histological alterations. Journal of Neuroscience. 1997; 17(19):7385-95.

98. Belmeguenai A, Hosy E, Bengtsson F, Pedroarena C M, Piochon C, Teuling E, et al. Intrinsic plasticity complements long-term potentiation in parallel fiber input gain control in cerebellar Purkinje cells. J Neurosci. 2010; 30(41):13630-43.

99. Shakkottai V G, do Carmo Costa M, Dell'Orco J M, Sankaranarayanan A, Wulff H, Paulson H L. Early changes in cerebellar physiology accompany motor dysfunction in the polyglutamine disease spinocerebellar ataxia type 3. J Neurosci. 2011; 31(36):13002-14.

100. Hourez R, Servais L, Orduz D, Gall D, Millard I, de Kerchove d'Exaerde A, et al. Aminopyridines correct early dysfunction and delay neurodegeneration in a mouse model of spinocerebellar ataxia type 1. J Neurosci. 2011; 31(33):11795-807.

101. Mitchell S A, Spriggs K A, Coldwell M J, Jackson R J, Willis A E. The Apaf-1 internal ribosome entry segment attains the correct structural conformation for function via interactions with PTB and unr. Mol Cell. 2003; 11(3):757-71.

102. Stoneley M, Willis A E. Cellular internal ribosome entry segments: structures, trans-acting factors and regulation of gene expression. Oncogene. 2004; 23(18):3200-7.

103. King H A, Cobbold L C, Willis A E. The role of IRES trans-acting factors in regulating translation initiation. Biochem Soc Trans. 2010; 38(6):1581-6.

104. Novac O, Guenier A S, Pelletier J. Inhibitors of protein synthesis identified by a high throughput multiplexed translation screen. Nucleic Acids Res. 2004; 32(3):902-15.

SEQUENCE LISTING (178 sequences)

SEQ ID NO: 1 - DNA, 300019 bp, Homo sapiens
  ref <308>: DATABASE ACCESSION NUMBER: NCBI / NG_011569.1
  ref <309>: DATABASE ENTRY DATE: 2013-05-06
  ref <313>: RELEVANT RESIDUES IN SEQ ID NO: (1)..(300019)
gatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggccatatccttttgcccgaaccccagcagcagctgcgcctccccctcctccctccgcctcccctcttccaggctgggagagagacccgggggttgatgggaggtggggaggaggggggtcttccaggggctgggagagggggcaccgggaggagtgtgaaagaatctctccaccccgagctgggttgagctaccctggaggcttgggaatgggtttgtggggggctggggggtgggcagcggagagtggatccttcccaaggaccgactctagaatgagatctggggcctggggtcgtgcaggagccttggtgggggctttcgagccaagtccggagggtttggagttctacggagtgagcttggagcgggctcgggcctgggcgcttctggccagggcaggggaactatgggggccttggttgggttttcttggccgtcgctcactggagtccacgcaggggaagctggacagcctctccactactgctttccccaaggtggggggccgccgcacttttagggcagggcgcttgggggctcccagggctaagagcaagagggagtccatgtggccttcacactgagaagccagcactggccgaagtgagtaccccagggtgggccgctgttcctatctggagaggatagtgatgggctggggggcgcttatgtttccctcatgtgtgcaggtcccattgcctttaaccgctgattggggaacctcatcatctttgggggtgtcgagaaagagatcccacttgctttatctgggcccctggcctgggaagacctgatctggacactttcagtaagaaagacagggcaacagcaaatgaggtggtgggtccattttagagcaccatgtccagcttttcctaccccgagtagccgagagggaacaccaggagaatcagcacccatgtggacatcttaggtaggtaaatgccttttaaatttttttttttttaatcaaagatccagaggaaaaaggtgaagcccacattttcttctgtggagatgctatcaaaatgcagatcttctgtgtttctttaaatccctgcctgcttgaaataaaccttgaggagggcttaacatctatcgagatgtaggcaggcaagggtgggtaattagtcgggctttctagcagttatctaagcatgacccagattccaggaggggggacacaccctgctgcccaggctggctggccactgtgccatgcccagatgtgccgcttctccgcacagttccaaccagctgccctctgtgtaaaaatgaacgggctggatgggtccctggggctcagcgatgagtcccctatcccttttgtatgtggttttgcagttatagactaaacggggctgggccctgtgtggtctccgggggttgctgtttgaggagcatggcgggtggtagagggactcacttcaggggggttcaaaatcgagcctggcgcttggatcctgggtgctgggattgcaacagagggcactgaggttttggagtgtgtgagtggtctactttgagggtggggaaaattaagaagttcagcagaggtgcttttgaggggagcatacctctaactacgatgccatctccgttggtgcccaaagcaggtgccaggtctttgcttcctaagtttcagactcttaaagaggctggttcttaaggttagcaattcctcaccatcccaggcccattgaagtgctcaggggtggcttgattactctgcctatcaacagagtgaggagtgggagtgccttgcaggaggacagggtattcatgggtgcacacccagttagctccaggagtgagagggctttgctcggctgacaggtttcctcattgaaaatggctttagatcgccttctggagcctggatttggagacttctaagaggaaaggaaggaggtggggagcccttctgctgtgtccttagcttacctctgtccagcctgaatcctgcagattggagggctgttgggggagagggggattgcagtggcccctcggaagggggaatcgtgggagagggaggcaggtgaattgcgagtgttgcttgccacttcatctattctctggccagctcgcccggggctttcttgctcttatgatgagtttgtgcattatgctctctgcagactgtttttgttctctttgacccgaggtaacaaacacattatacagccctactctggaagggaaaactccccacctcacaatctgtcatcgagctgggtcatccaggactgagctttctctgtcctggatggagcggagggcggtggcggggtgggtgggagggttggagatgagaggggatggacagagacctggggagggaggtagtgaataaaagaattcaggccagtgtaaagagaaagacacgtggaatgtcagagtcacgataccagggcagaacattctactttttaatctaaatatttctgccattaaaaaaaaatgtttcagcatatcctgagagtgaaaaaaaaagtgtgtaggtacttaaataaagtctaatatatgtacaggcaagtacatatattcagatgcatagatttttacaaaatgaacacacccacgtatccagcacccaggtcccgatcagtgccctggaagtccccctccccataccgcctcctagttgctcccccaacaagggtaccgctcacctgacttctaaggttcattttgcctcttttaaacatgtaaatggagtcacacagtacgttcttttgccactggcttcttttgctcacatctgtgtatgtgactctactacaatctatccattctactgttgatgggcatttgtgtcatttctgtttgtgccactgggaacattcttgtgtcttctattatttttttcccacagttctcttagataggagtggaatcgcccctgctactttttgatgcatgtgttgtgggatgtgtatttggaaatggtgttgactaagggttgcaggtcgatatggaaagcaggttcctccctgtcttgtttaagagaagtgagtgaatgatccatgaacttgtcggtatgctcacagggcctaagagtgctacttccaaatgtaaattctggcatggtacactggtgaaggatgcagtcttgctttctccacactcggggcaatttgtcactatgatttcttcctctttcatccctcagtgggtcaaacttgaagccatcaatgacaattaagaatcctcatttatttcattttttcccctcttcctaagtgaggaaacccaaatggaagtctttgatgttcaaatttacattgccgtgtttttctcatgccaggcagcaagccgtcttgaccacacaccttggtttcatgttttcattgactggaattgtgattcaaatagggccatgagggtctctgatgattgccgaagagctcagatctgtcagctcaaaaaggagcatctgtcagccttcctagagttccctccccacttaatgccactcactccttctaccaagtgccaaggtgaatgtcatctttccagccctccctgtgccaccaggtctcccactgaacatgatgtagaaactcaggccatcggaggaacactggaagcaggtcagtgtattatcacgcacagttgcctgaattacacgtagaattccagcttttcatccggtttgcagaaatcttaacaagacacctaaagtcacattgacatcaggtgacatcactttgacatctgtggacattggctgattggcactcctctcatttttttttttttttttttttttaagaaaagctctctaaagagaaactttctgcatgagaagcgctgggagacatgggagcaggttatcagactcttggcctgtcctgagagatagaatgttctagaaggtactgccgtagagggcaggatggtgtcacttacgtgatccttgtactagaccggcttggctggtatttccagaggagcaaaattctgcgaagtaaaatttagcacggcttttccaatgggagtattttcaaaaagggtgcaatttcttatccacaattccccaatccaaaaagctccaaaaaccaaaagacgagctcatatagaggtaaaacctaacctgaactgacttcagtttgaagtcttaatttacagttttcattcattctacttggtgtgcatttgagtatgttttgcagcagaaatgttagatgtgcttgatgatgaggtgctgcttcagctcctgactgttaggtctgcattgtagtcctgtcaaactttcaggtgtatggaagttgtcttgttaacaggatggttctggtccagcaggatttgggtggggtctgggattctgcttttctagctagcttctagggattccccatgtggtaagttcatgggctagggttggagtatccaggttagatcatagagacatcttgttatcatttttcttttccttaaaaatcaggtttataggggccgggtctggtggttcacgcctataatcccagcactttgggaggctgaggccggtggatcatgaggtcaggagttcgagaccagcctggccaacatggtgaaaccccgtctctactaaaaatacaaaaattagccaggcgtggtattgtgcgtctataatcccagctactcgggaggctggcaggagaatcatttgaacctgggaggcagaggttgcagtgagccgagattgcaccactgtacttttttttgagactctgtctcaaaaaaaaaatagatttattgatgtataatttatttgtagcaaaattcacccttttgacatactggtctgcaagctttgacaaatggatgtagttgtggccaccacccaaatcaagatatgggacagtttcatcaaccctaaaatacccccacagtgcccctcttgagtcagcaccccacttctccagccccttcaaccactgatctgttctccatccctacagctttgccttttgccgaaggtcatataaatgtaatttcacagtatatagccttttgaatgtggattcttttactcagactttgagattcattcatgctgttgcctgtgacagtagcgccttcctttttggtgttgagcaggattccatgatatggatggaccagagtttgcttcccagccgaaggacattgggatgcttccagtttcaatgattatgaatagagctgctataaacattggcttatgggttttagtgggaacatttcatttcatacatttcatttctcttgggtaaattaacccaggagtgagattgctgagttgtgtggtaggtgtatgtttaattttataagaggctctcaaactgttttcctaagtggttgtaccattttacattcccatctttgcaatgcgtctaaaagccctgagttctgaattccaaagcacgtctggcctcgatggcttaggattaaggatgtggatctatggaaaggagtggaagtaatagtgttaaatcccggtcagagaaataagaaagattaaggatgtcattcaaagctatgtgcctgcactagagagagagaaagaaggggttctcttgggtggggttccacccctccctggtagttctaccattccccaggaaaaagtcaagctctgaggctgtgagacccatgatctttaccctgttcttcaccactgcaaccccagtgtgtgggacaaagcaggcgtcctataaacgtttgctgagcaaatgagaaaaggtacctgtcttcacccattaactaaattgtataacatctatctgatctacccttgtgccaacgttttaggattttgatgggttttagttgcagggggttgagagactgtccatgagattatcagaccaatgaaagtttctgaaatgttagtgcttgagtagattggatgcagcggccccttgagaatgaagtctttcttcagggacttggagtgggaggcatctgttgggtgcgtagggcttatgcttccccctccctgtttcccccccagtagcaagcacacatatacactttctcagcaataaaaagcaccgccgggaaggtggactccatccagaaatgatcagagcctaagagccgtgcagtaacgcatttccgagaatgccagctcagctcctgagaaaagggccggatgggatggtgcctgctctgaaagagggcagagaggagagggaaaacactccggactctgggtcagactggcccaggttcacattattcaccagccatgttatcttgggcaccagagcctatttcttgacatgcatgatgaggatattccttctagtagcatctcccttggagggctctcaggagattaaatggggtcgtgcgtgaaaaatggccagcacagtctccagcacagagaaaaaccccaaaacgccagagccgtaatactatggagtcatttaggttccagtgttctttttttggaaaccggccagaaaagaggctttctgggtgggaatgggagcgaagtgcccccccccaccaccccctgcgactggtcagtgtggattgattaacctgatcgtggcgctctttaaagccacctttggacattttgcattctccgttctctctggaagctttcaggggaaaaaaaattcgtggccacttgacccatttttctattcccttgagtctaaggtaaaaattaattctctttcctcctttggtccctccctctctctgtgggtgacaaggtgagggagttttaaagtatataattagcttccctcttccccttttgcactccctgtctcttcctttggggccggtcgagagtgcagcccaggatggccaccccaggtgtccactgcaaactccacagaaaaactttgctcaacttttggtttagaatttaggtacccccctccccttccaaactttggtcttctttctcctcactccctaaaaaaataggaaaaacaaggaacattcctggcgagggaaccatgagtgggcacagcaacttaggtttcaaaaaccactgggcctcagttcttatctgagtagggtgacccttcagccagggttgcctgggactatcctgggtttagcatctctggaaactcacagtcctgggcaaactgggacgctggtcaccctaatggtgagttcttaacacctgagagagaagaatggtgcaagagatggtgccgttgaccaagaaagggggagagtcagttacttattccctctgaaaagccaagactttttattggaatgaatgcagcttttagaagccgtctttaaggcagctaatacaagagagattccagctatgaagggaaatgcctgagttaagtccggatcaagttttgacatctcgcttcggtcagacacggctttatctgccgttcagactgggagcagccgtgagtcttccttaaaggtgcctgttgctcaggcggcacctgcagttagaaattagcagcctcccacccccagcccccaaataacaggattcaagagtcccctctctgaagccatgagggaaacccaacttagtcacccacttgccagtaaataatattcatgctgttaagttctgttctcattttaggcctatgtgtaaaaaatatatgtaattttaaactgatttttaaagtattttcatacgaacagcatttgcaggagggcgaagtctggatgttacctttttgtaaaagtggatggatttgtcttcaatgagactctggggcagacttaaaacttggcccgcagtggtgttacatggattctgatcttccagagtctgtcacgttcttttatctccatgatctttattatcttctttattgagaatgatgggcatggtgtgtgtgggtgggagggctatgctgaccatcactgcagtgaaatgtgttcgtggcatgttgtggcgtctgcataggaatgtgtctgtttgattaacagcacaagcagtggaggctgtaaggaggaaaagaggagggaaggtgatattggatggaggggagacatatagagcttgggaacagtccaccctggctgcaaatctcagctccagctcacagttgtggagcctcagtcttctcctctgtaaaacggggacagtagtcctatgtccgaggaattgtaagaaggttaaaagatactgtacccagaaagcacatggcatatataatcatcctgtgaagtagccaactcaatgaattttattttatttattttgagtcagagtctcactctgtcacccaggctggagtgcagtggcatgatcatggctcactatagcctcgacctcctaggctcaagcgatcctcctgccttagcctcccgagaagctgggactataggcatgcaccaccgtacccagctttaacaacataaatttatatatatatatatatatatatatatatatatatatatatatatatatatatatatattttttttttttttttttttttttttttttttttgagatggagtttcattcttgttgcccaggctggagtgcaatggcgcgatctcggctcactgcaacctccgcctcccgggttcaagcaggacgatgggcatttgggatgtttctagtttggggtgggggattgtttgtttgtttgctgttatgaacaatgctgctgtaaggaatcaataattttgaatgaatgaattcgaggtgttaattttagtctgtgtacttggaaatctagcttcacctagaatcagctgagattcatcagcatttatggcaggagctaagacatttcacagcttactcatcattttctctaagaggctgggtcaaccggttagctcttggtcctgcttgtattctgagagtcagaacctgtggtttagacactggcaattgatatggttgtagagaagcagcatggttgagttgagagcatggattctggagctaggtggctggggttcaaatcccagctctactagtcactggctgcgtgatcttgggcaagtcacttaagtgttctgtgcttcagtttcccagtctgtcccagtggtgattctaatagctccatggggatcctaatagctcctatctgggaggattaaatgagttaatacatctgatgtttagagtggtgcctgacacttaggaagcactatatgtgtttatacatggaagagtggatagatggatggacttatgtgggtggccatatttgggcttctctgatccactgctgagaatagtgtgtggcacacagtaggtgctgcataagtgttaatattctgctctttcttgccaagtctctcaactcccttgatctctgttatttttggcgtctgtgttgttaacccattcttctgaatgatcagctgaatcactgttgctccaatatataagccaaggagaacacaatcacaaggtctcattgattgtccatactagaattccatgattcctaggcccaagtaggattttccccacgtctcagcaatccttcttccatgtttctaatctttttctctcatttgttatgccccattgccagactctccaatctccccacagcttccccttcctctaactatactgtctctagtcttaccttctccctaagggcaccgtctttgaagacatcaaatacttcagagcaccaaatataggttagcttctctgagggccttacaaggacatggagtgtttgggtcttacacaaattggaatggtcagaaatgtttagagacttgagttgtctttgaaagagttgtcagaatgcaaatttttgacttgtggcctgtttctgatcacaacgcagtcttttaagttatggatcatagctggatgtttgtggtttagaggggatggaggcatcctctgcagttagtgttggatgtctgggtggatggatggatggatggatggatggatggatggatggatggatggttgaacagatgcatggatgagtggatggatggatggatgggatgaaggaaggaaggaaggatgggtgattggagggtaggtgggtggataagtagattggtagatgactcgatgggtgggtggacaaatggatgggtgaatggatgactggatggatgactggatggattggtgtatgagtgaatatatggctggatgaataaataggcagatgactagactggattgaggggtaaaaatatggatgactggatgggtggatgagtggatgatagatggttgaatgggtgggtggatgggtggatgttggatataagggtgtatggtagggtagctgtctatgtgtgggtctccctgatatttggtgttctgtttgacttgggaatgaccaagtctctccgcttaccaccttatttgtaccttttccagtatcaagtgaattttgcacacttttgtaaaaatcaataagattgtatgtttaggactttgggaggccgaggcaggcagatcacaaggtcaggagatagagaccatcctggctaacagggtgaagccccatctctactaaaaatacaaaaaattagccaggcgtggtggcgggcacctgtagtcccagctacctgggaggctgaggcaggagaatggcatgaacccgggaggtggagcttgcagtgagccaagatcatgccactgcactccagcttgggcgacagaacgagactccatctcaaaataaataaataaataaatattatatgcttaggttttacctatgtaattagaaagctccttgagggtaggggacagtgatttgccttcctcacatccccccaaagttcctgcactatatcatgcataagtatttaattgagtaatggtgaggaaagtaaacagtgttattgaacaaagattattaaaattctggaaacacctggttttgtttcagcactgggactgaaagtggaattccttggattttgctccattggtggataggatagcatgtggtggtggactggtagactctttctcttccaagcagattgggtaaatgccccagattcttacccactagtcagagattacagattactgattgatatggtttttctctgtgtccccacccaaatctcatctcaaattgtaatacccacatgtcatgggagggacctggtgaaggtgactggatcatgggggtgatttcccccatgctgttcttgtgatagtgagttctcatgagatctgatggttttaaacttgtgtgggcctctttcctctctctcctctcctgctgccatgtaagacgtgccttgctttccctttgccttctgccatgatttgtaagtttcctgaggcgtccccagccatgcagaactgtgagtcaattgaacctcttttctttataaattacttttatagcagtgtgaaaacggactaacacactgatgtagcaaggtcctttaaggccccatgtgatctggtccctgttttgtctttgatctcatctctttcattgtctaccttcctttcattgtctattctgtctcagccctgctgaccattttactcacacccatgtcatttgcattacatgacattccttctgttcagcataagctatttcctctgcctgcatcactgtttctccaggtctccccatggctaactccttctcttcatttaggtctcagcccaaaagttacctcctccaagaggcctatccttttcatttactgaacatctcatgtacaaaaaagaatataaaatatatgtatactctctcatccacaaaaaaatctctgaagacattttaatgtatttcatcccatacctttttatgcatgtaaacttttaggaacacatttccatgccactaggtatccttgaaaaaataagggccaccatgtatagttgcacaggttgtgcactgcacaaagatagcatgtcacatatcttaagtatcatggagcttgtatgtctactatttcagtaccccagctgataaaagcttaagtatcttgttctagcaagatgaagctattatgacaatttttgacagagaaaggggtgttttgtttaagttcacaatcagagaaatgggtgtcttgtttaatttcacaaccagagaaaggggtgtcttgtttaaattcatacagtggtgctgtatgggttggtggcaaccccagaaaagactgttgttaatatctgataatgttccactttatacgtgtattatattcatgtaacaatctctggctgtttgttttgccattataaataacagtgcagtaaacatctttgtgtgtgaatctctgtccaaggttctgatagttttctgaatgaaattcctgtctatatatggcactccaagcccataattgaaactctgctgttaccactttctttgaatctgtagaaggaattttgagaacaggtgactggtatattcaggatgttgatgacaaggaacagagaaagaacagttaaatggtttggaatttttcctgggctgcatgtaaagcagtgcttttgaactgggagcaatttttcccccaaggggacttttggcaatgtctggagacgtttttggttgtcacgaatgtagggggagggggcaagatgctactggcatctggctggtagaaaccagggatgcagttcagcatcttaaaatgcacaggacagcctttctcagtaaagaattatccagctccaaatgtcagtaataccaaggttgagaaatcttgatgtaatcgatgtcatgggtttcttcaagaggagtgggtggatttagggtttttgggtgacttaaatttaatttacagtttgtcttcctagctgggtgtctaagccagctttctgtgaactttagatcccacacaagaagcaacaggcttgctaccgacagattcgttgatgtaaatatagatgagtgtatagaaggaaatctcacccagagctggaaaatgttggaatgaaaactgcggcggcctccccttctctctccttccccttctgttgccctgtttgaaaatcgtgccttactttctttggtctcctggcatggtgaatgctgctggtatggactgtgtttctatatccccttgatccccacacccttaggaacgtacaggagagagaccctggagcatatcagcttagagatggaggggaatgggaaggagtgcgttcattcattcataaatgttgactgagcacctactgtatgctaggtgaatgggaggacgtgagggcagggaggtgacaaggttggcttattctgggctttgtgaactatggtgaggattttgtttttttccaaaggaaatggaataaccactccttttttccccccgatatacctaaactttttgattttcataacaaaaatgggcttccttttgtatatttgttttgagaccagccgtttttccaccaacactgatcacactgcagtgagcatcctggtagagaagtctttgcacacttctgtcactgtttccctaggacagattcctggaaatggtatggcaaggttgtatgtcaggcttttgggccaggttgcaagaaacaggaagtctgtgccctttcaaattccaaggtcccctttccctgacgacgtggcccaatcaggcttgccctcccttgattttacatcttcaccaatcagataagtgaaagtgaaatcctgttgtggtatcctgtgcatttctttggtgacttaagacatagagcattttccagatctctgtgggctgtttggatatcctttcctctgttttctcaggcacattctttaccgatgtctttgagggattgagcaagtttctgttgaaattgaggcatgtcatggctctgtgtggggcttgaggcagtccagtgtagtggagggagggaggctgtggagcctggctgcctaggttcaaataccaactctgcttatttccattcatatcattttaggcaaatcacttagccccctgggcctgcctttcctcatcagtaaaagtggtataacattagtgcctgcattgtggggtggttgtgaggaaagcagcactcaaaacagtacctgacacacagtgggtgccaaataagagtctgatgtattagtgttataggtatcggcctcctccctccccagtgcaatagtgtgtgtgcgcctctgtgtacctctgttggtgctgacaagccctttttaaaatttagaggtgaggtctcactctgtcccctaggctggagcacagtggtgcaatcatggctcactgcagcctcaaccgcctgggctcaagcaatcctcccagcttagcctcctgagtagttgggactatcggtgtgcaccaccacacctggcccttagacagcccctttatttcaaagcgaaatggcagccacaagatttagtgcaagctctccaagctttaggaccagctgcaactcctctaactgaccaaacaggatcccccatgtccccaacccccaaaacctgatgaaaagcaaacagaccattttccacattcatgacggaaaggcccttttcttggctcctgcccttgctcatgtcaggatttcactccatccctgataaagaggaagcaccatgtcccaggaggacatggaaactctctgctttgtggtgaatagttacagtaacagtagctcctctctgtggggagcttatgagcccctaagctttatagaactgccctggcagtttatgagaacttcatcccagcccccagagctcatggcacttatttttgcccccagtttgcagatgtgcacactgagactcagagagctaacactgcttgccaaggtcacacatctagcaaatggagaaactttatgagacaggtgaaggcacagcaaggataaaaacccagagggaaaaatactcaagttttctccgggaaaccatttgcattccagagaggttggtgtgcgagtgggcaagagatgtcgcgggacgatggttaagggacagagtctgagctcaactaggactaggtttcttcctttccttccttccttcctttcttccttccttcttcctttcctttgtctttctctccctcccttccttcttcctttccttcctttcctttctctttccctccctccctcccttccttcttccttccttactcctttccttccttcctcctttccttcctttcctttctctttccctccttccctccctcccttcttccttcctttctttccttccttcctttttcctttctctttcctttctttcctttccttccttcctctcttcttccttcttttctttctttcttttctctttctttctttctttctttctttctttctttctttctttcctttctttctctctctctctctttctttccttctttctccttccttccttccttcttttcttttcttttcctttcttttcttttgttttttgagatggagtctcgctctgttgcccaggctggagtgcaatggcacaatctcagctcactgcaacctctgcctcccggttcaagcaattttcctgccttggcctcccaagtggctgggactacaggcacgcgccaccacacccagctaatttttgcatttttagtagagatggagtttcaccatgttggccaagctggtctcgacctcttgacctcgtgatcctcctgcctcagcctcccaaagtgctggcattacaggcgtgagctaccacgcctgggctaggactaggtttctatcggtggtgtggcttttgggaagctacctaatcttaaccactctgtttcgtcatctataagataagcagtgtagcattttcttgcaggaatgttgcaaggattaagtggatggtgactgtaaaacatcatgcgtggcacatagtaaattctcagcaggtagtcattgctggtcatttacttttctctaatgaccagcaagctcttaatttcctccttggcatgggcactgggacgtagatggacaaaacacagagagaaataaacacacggacaaaaatccccgccctggtgtggctgatattctgggtggggagagagagggagtccaaggaccagataaacaggtaaaggatagtttgagtgtggtaagtactaaggctcaaaaataaagatctcccaggtgatcttagctgcatttggaggtgacaggagatacaactgagaaactgagataggaggaaacccaaggggagatgtgggcttgatttagggtgatctgaggagtaggagaagtcaggggctggtgtggggaggctctgatggttctctctggggagtgaagcagggattcgttggggagacccaaggggacaggtgaaggcccctgaacaggtggccagtgctgagaaaggaaaggtggaggacccaagtgagttcctaatttcttcattgctcccctaaggtgtttgtctcacccttggccatagtcttggatcacttacagatgcagaccaggctgggctcaatggcttgtgcctgtaatcccagcactttgagaggctgaacccaggagtttgagagcaggctgggcaacatggtgaaaccccgtctctacaaaaaaatacaaaaattggccgagggtgttggcacatgcctgtagtcccagctacttgggaggctgaggtaggaggatctcttgagcccgggagacctatgctgccaaataaggtaggcagtagccacacatggctattgcaattttagaaattaattacaggccacatgtggtggctcacacctgtaatcccaacactttgggaggccgaggcgggcagatcatgaggtcaggagatcgagatcatcctggccaacatggtgaaaccccatctctactaaaaatacaaaaattagctgggcatggtggtgcacacccgcagtcccagctactcgggagactgaggcaggagaattgcttgaacccaggaggcagaggctgcagtgagctgagattgcaccactgcactccagcctgggcaacagagagagactccgtctcaaaaaaaaaaaaaaaaaaaaaaaaaagaaaagaaaagaaattaattacaataaaaacagtccctgagtttcactggccacatttgaagtgcccgatgaccctgtgtggcttagtgaccactgtgctgaatagtgcagatctagagcatcctactggacatgttgccagggtccctgaaccaacagaattagcatctcctgggagcttgttggaaatgcagaatctcatcccctaccccagacctgctcaatcccaatctgctcttcagtgagattcctcaggtgatcttgactgcaccttctaatcacttggaagctttaaaaatgctgaggctgggcacggtggctcacgtgtgtaatcccagcactttaagaggccaaggcgggtggatcacctgaggtcagaagtttgagaccagcctggccaacatggtgaaactccatctctactaaaaattacaaaaattacccaggtgtggtggcacacacctgtagtcccagctacttgggaggctgaggcaggagaactgcttgaacctgggaggtggaggttgcagtaagctgagatggcactgctgcactccagcctgggtgacagagtgggactctgtctcaaaaaaaaaaaaaaaaaaaaaaaaaagaaaagaaaaaggaaaatgctgatgccccaagctccacccccacagatgctggagagatttgtccagggcttcccctggagtggggaatgtttgaaaactccccaagggtttctaaagttcagccagagttagcagaaagcccattaggtggctaagcaggtagactgaagttggagctgtgtgaccttgggcaagccacttaccctctctgaaccacaagctcccttctctctaaaactagagacctgctggcacctccctcccagggctgtgagaagtaaatgatgggatgattcaaagtgctgagtagggtcagatgcagtggctcacacctataatcctagcactttgggacgctgaaatgggaggattgcttgaagccaggagtttgagaccagcctgggcaacatttaaacattacccaggtgtagtggtgcatgcctgtagtcctagctgcttgggaggccgaggtggggggatcccttgagcccaggagttcaaggctgcagtgaacaatgatggtgccactgcactccagcctgggggacaagagtgagaccctatttctaaaaaagaaagaaacccaaaatgctgagcgagtgccttggattgatagtaagcagtgcctgtgtaataagcatgaattttaaaaaatgaggtcagcagccttagagctaatggttaatgggtttgggtgtgggatttttttttttttaatttttaaaacattgagataaaattcccataacataaaattgaccattaaccattttaaagtgtacagtttggtggcatttaatacactcagtgttgtgcaaccatcacctctctgtagttcaaagaccccaaaaaggagaccccgtactcactgagcgctcactccctgtctctccccgctcccccagcccctggcaactactaatcttctgtctgtatagattgacctattctgattttgggggtttttgaactcgccttccctggctgacaacctctcgccatccaggtgagactgtgtgaaagcccagctccctgcatttctgggtcttcctctccccactgggggctgcccccacctgtttccccctctgggcaccctggttctactcatcagcctggcttaatcccagcagcaggtccatgttctgctctcctgtggctgccacaaatgagaggtttcatctcagctgggtttctcctagttaaatatttaataaataagacctacaacttgtgatgctgggagtgtttgatagtgaaattaatgatggggagagagtggcaggcggcccacaggtccatgctggagctgggatgaggcgccctgggcaggcgtccgtgccactgatgcttgggaaccacggtgggccatgccatcccatttcccccagccagggcctcttttttagcactgtgtccagcacagggtagccacctgataaataagtgttaaaagaaagagaggctgcgtgtgtagggaagaaggaagagacagaggagacaaagaggagacacagagagagagagagagatgagagagaaagaaaagtggaaggtgagaaagagacagagatggaaggggagagaaggacctggatggaggaagtgcaaggaaggcaatggtgagggaaaagagagagagacaaagatggaagggatgaaggagagggagagatatggaggtagagaaagagagacagaaagaagagagagaatattgcttcttgtatcttccccttctcctgttatccttgaccatcttattatttttttcttttttctgtctctccagttctcatttccttaccctcgccgtcttgccaactcgtcatctcttttcatttcctgtgtctatgttatcttttaattttctgtctgggtattttccccttttctctttctcagcataaactgttggttggtgtatgtgtcttctttcttttttagtctttaactgacgtgtgtgtgtatgtgtgtgtgtgagagagagagagacagacagacagagagagagagagagagacagaacaaacctagagagcagtgtaggaacatagatgaacattttaaagaccaaaccatgaagcgtacacccattttacccaggtcaagagccacagggccaccatcagattctccctcatgctcatcctcaatcacagccactccttccctcctggaggaaccactattggagattgtatgggaaccattcgcttgctttcttgtgtggttgtaccacctaagtacgcatcctgaagcaatatagtcagatattatgtggttttgagttttatatgaataaaatcatgtgagaggagttgttttgtattttgcttcattggtttgcagttacctttgtgagatttcatcctcattgtggtcactgcagctccttcatgatcttgtttattcattgatgatgagcatgtgactttgttctcttttgggcactggcataagcagctttgttggttgtttatggattctgctgctcgcttgcaggggtctctctggagcacatcgctctgtgtgaaattgttggatactaagatttgtacattttcaccttgactaaacactgccaaacaattttccaaagtgcttgtgctaatttacactcctgccggtggtgggtgagcattcaagatgcttcacaaccttgccaacacttggtattgtcaggtttttaagttatagcctttctcatggtgatttctcattgtgattttagtttgcatcccccgattgcaaattagagtgaacatagtttaaaatatttattgactattcaagcttgcttttttgtgaagtgcctctacatgctctgtccatttttgattaggtcacttttaaaaaaaaaatattgatttgtgggtgatccttacatagcctggaaactgattcttcatcattatatgttgtgcaatattttctcttggcttggcttttgatcttttttataatgtcttttgatcaccaacagttcttaattttgatgtggttgattttagaaatcttttcctttatagtttgtgggctttgtatcttatttaagaaaatcatttctaccctgaggccatggatatattttatgttatttctgaaagttttacagttgtgttcactgtatgtctttaatcagcttgggattgatttttatatgtggtggtaggtaggggtccaatttcctttttattccataagaattgtcccagcatcatttattaaaaagcccattcttgccccaatgatctgcaagacaacctcttgactgtttaacttttaccttctttcatctggtctgtttttatactcaacctttgaagccacaaatatttattgagtgccaactgtgtgccaggcactgagttacagtgacggatatgacagatgcaatcatggctttcatggagtttacagtctggcaaggatgacatgtaaatagttattactacttataatttaaaatgttataggccttgcaaaaagggacaagtctggcttgctctaaaagaaacatgtgaaacaacatcttccagggaagtgctgataaactgagtctttagtgggcctctgctattgtaggggtgggaatggtggaaaagatgttttggccacagggaacagcatgtgcaaaggtcctgtggaaggtgcttaggagtttgatatttatcctaaaggcactgtcaggctactgaagcagtaatacaatgattttatgtctgtgaatagttccactggttgctgcatggagaatgtattggaatacagcaagaataaaaagccatgagaccaattaggaaatgatttcactcattcagggaagtgtgccttgggctggcatggtggctgtggagatggaaatcattgatcagattaaaagaaattttgagctggcatgatttttcccctctctcccctctctctatctctgtttcttttctggttgtgttttctgggtgagaaaagcagtttgtgatcctgccaagggtatgtgctctggaggatgtatttgccacagatggtctttggaattctggccaagagagtcactggacagcccctggcccccagggtttctggagccaattcaacaatgactgtttattaacaacagcaaggatgagttgctagcctttccttcagagcaccttttaactgttaccttactttgttacccaaaccgacactatggaattggtgggggagaagtggaagggtttttatctccattttttatagaacgggggaagttaattggcactcttgaaatcatacaaaagatgttggtttcaggattggtttctggactttcagcccaatcccaattactcaagctcacacacccaatccccaaacatactcttttgcaaataatttccctactgaggtgctcctggccaatttaaaaggtccccatttccttgcctataaaatgggaattaaagtaaaaatatctacctgttgacttgctgtgaggtcagtgggcctgacacatggtgtggactcattatatttacctatgtgaatcccttagttccctttacttggaagaggtggaaaactcaaaggggcttaaacaagaagtggggattgtattggctcatgagactgaagagtctcaggagtgtccagcttcaggcttgtttggatctagggatcagataacaccattaggcctctgtttctgtttcttggctctactttttgcagctggctccattatccatgacttagctgcacttccagccctccagtctgcccaagaccatattcagagagagattcttctctctttttcagctatcttcccggaattttcagcaaatgctttcttgcttttgattggctgttgctgaggtcgtgtgctcatgccagaaccaatcactgtggggaaatgggaggtggagaacggggtgctctgattggcttaggcttgggtcacatgactttatggagttggggtggagccaacttctccaagtggggaagagcagtcttcttaaaggtgtattaggatatgcttgctgctgtaacaagcaacccccaagtctgcagtagcttaaggcaatacgaatgtacttctcactcaccctaaatccaatcagataatcagcaagtggcattccatgtggtgatttcaggacccggctctttccatctgtggctccaccatcccctaagatcagaaagtccttcacttccggcctgtaggaaaagagtatgaaggctcacacaggaagttttgggaggccacatatagaagtagtgaaccttacttctgcctgcattctgtggactggaatttcatcccatggtgtatgagagagggtcccagtaggaaacggaagacacagaccaagaatcaaattaagagatagcttaagaatcaaattaagagatagcttacaaaggtgtgggcccttactgaaatagagaaggaggaagagaggaaggaggcagagacagagagagactgagactcacaaagacacacacacacacacacacacacacacacacacacacacacacacaagttgagagaaagaaggggggagagaaagagagagagggagcatttcctaacaggaagctggcagaataaatgtcccccattgtccaaagccagagggctgggagcccagtgagcccatccacacaggtcagccccccatgtgacagtcctagaagggtaaagaaggaaggagagtggatttggggtaatggaagacagccaatacccatggtccatctgactgcagggggaactgagaaattcagtccatggagaagaaggtttagtggacacgtcactttgtctttttcacaaagtgaaactaggttctcaggtggaaaaaagaaaaagaaggtttgccttgctgctattctttttttttttttgagacggagtctcactctgtcacccaagcgggagtgcagtggcacgatctcggctcactggaagctctgcctcctgggttcacgccattctcctgcctcagcctcccgagtagctgggactacaggcacccaccaccacgcccggctagtttttttgtattttagtagagacggggtttcactgctagccaggatggtctcgatctcctgacctcgtgatccgcccgcctcagcctcccaaaatgctgggattacagacgtgagccaccgcacccggcctccttactgctattcttattattggtggtagcagtggtggtgatggttattggttcttagttccctctacatgccagtatctgctctcttctttttttctcccttacttctttccttgttctgcaaattctttccctttaagtgaaaatctttccgtgttctccaagggagataaattctatgccaagcttgagtgtggggtcctctgcttggatagctgtcttctccaggagatgaggtagaactgagatagtgggggtctctgcaggcagtctgtgcccctggcaagcccctcaccttaacctgaggctgggtggggaaagatgccttgatggagtcagaacagaaagcaagtgatcgctgcctgaaccaagcagtcactttcctggaggtgaaacctagaaacggtccctcaggctgggtccagggaggtggacttgggtcccaggggcaggaagcaacctgcccctcacctgctcctacctctttgtagcctatcttggcaaccagaagtaggtatacaagtgacgttgaagctgggcatgttaacaatggtgtgagcccgcctgactccaatctggtccagctgtactggccgtgcatcctcatctccagcccccagggtcagcccagcggctgtaacaatggtctgtcccctccccgccccacccacttctttgaactcctccaaggatctgtgatgatagggctgtcactgtcttagcttccaccattcaagcttaaccggccttcttcccctccatggagaacggaagagcaacccctcattgcctctggcagctgaccagcaggtccctgccttctgcccactcccaggtctaggacaatgaggtgagaggtagacaggaccaagttccccagtgctgtcttctaggtccacctatcatgagagccgtgattcctagtttttatcaccctctccccaactttgccagctctccacttctggcagtggtggctgcccatgacttcaccttcccgtgcctcagtttcctcatctgtaaaataaggacagccatggtaatgagagttctggtcaatatgccaggcacctcgcttgcatcaatttagctcatcctttcagtgccctgaggggtgggtactgttatcatcccgtgtaacaaaaagagaaaaccgaaacagagagagagactcactatctgaggtcttgcacccctcaagcaacaaaagtgggatttcagcctaggctatctagattcggagtccacggtctcaatgaataataacaacaataataatattgtcctaatctgatgagtttttgatcagattcaatacaagagcataggcagaaaagcttagcccagtgcccagcacatggtaagaactcagcatgttatttataatagtaataaaccattttatgttatgtaattatatattcatagataaatatagttgactcttgaacaacataggggttggggcaatgacctcctgtgcagtcaaaaatgtgtgtgtaactttttttctctattttttagaaattttaaaattagagacaaggtctcgcttttgttgctcaggttgatctcgaactcctgggctcaagtgatcctcctgcctcagcctctcaaagtgctaggattacaggtgtgagcccccgcacccagcctgtgtataacttctgactcccccaaagcttaactactaacagtctattcttgaccagaagccttaccagtaacataaacagtcgatgaagacagattttatatgttatatgcattatatactgtattcttacaataaagtaagctagggaggagaaagtattattttaagaaaatcataaggaagagaaaatatatttactattcattaattggaaagggatcattataaaggtcttcatcctcattgtcttcacattaagtaggctgaagaagaggaggagttggtcttgttgtctcaggggtggcagaggtggaggtggaaggggaggccagaaagacaagcacgcttggtgtaactgttattggaaacaaatctacataagtggacccataaaattcaaacctgagttgttcaggggtcaactatatatgctacaaatacgtaatatgctaatatagttgtatgttattgttatagtacggggatcagaaaatgttttctgcaaaggattagctagaaaatgtctagtaaatactgtctctttgggaccactctactctgccattatagcaaaggcagctacaggcaatacgtaaatgaatgggcatggccatttgccaataaaactttgtttacacaaacaagccatgggccagagtttgtcaacggctggtatagtatatgttattatatattagctttactttttctgttgctttgtttatgttcttctttgcccttcctttcttaaaggccagcctttctttctctctgttggtctgtcttttaggacagcatggcaggccactgggacatgggctctcctgactccaggcttgtttgtctgataagacatgaagagtgaaggtggcaggactctgagctcaggcctgtcctcctcctcttccctctcttcgttttttctttcctctttcctcttttcttcccaagctccagaagttgccattttcctttcccattgctgattttctctgccttgggagaaagcccgagaagatcacttggaaaagcccacgagcatctctggcctcactcacccagctcctgccattgtctttactcttcctcagacacaccaggcacagtcctacctcagggcctttgcactggctgtttcctctgtctgcattgttcttctctcaggtgacctcatggcttctccctcctctccttcaggacttcactcaaaggccaccttctcagcatttgcctcccgcccttctgccttattttcccctttggaacttttcaccttcttacttactcatctgtctgctatctgtcaccctacatcactatgatctccacaagggaaggtgattttattcgttttttgttctgttttgttgaagatgaggttttgctcttgttacccaggctggagtgtggtggcacgatctgggctcactgcaacctccacctcccggattcaagtgagtctcctgcctcagcctcctgagtagctgggattacaggcacccaccaccatgcctggctaatttttgtatttttagtacagatggggtttcaccatgttggccaggctgatctcaaactcctgacctcaggtgatccacccacctcagccttccaaagtgctgggattactgtgagccaccacacctgatcttttggttttacccaccaatgtggactagaacagcctagatcagcaggtggcatgcagtaagcagttgataaatatgtgttggatgagtgagcactgtggcttctgtcattctgttgctcaatagcattcatctggaaataaccacagtttgtttatccatttacctgttgattggcatttctgttgattctcgtttgggccattatgaacaaagctgctgtgaaatacttatacctttgcccaattcttcacttggtgaacccttataaatcctttaggccaggtgtggtagctcacgcttgtaaccccagcactttgggaagccgaggtaggaggatcgctggaggccaggagttcaaaaccagcctgggtaacatagcaagacccgtctctacaaaaaaataaaaaattggctggacgtggcaatgcatgcctgtagttccagctacttaggaggctgaggtgggaagagtgcctgagcccaggagttcaagaccgcagtgagtgatcgcgtcctgcactccaggctgggcgatagagtgagaccctgtctgtaaaaatgacagcaacaacaacaataataaaacctttaggtttcctcttaaaaggaacatccttagagcttttcctgacccagcaactcaccccaagtctgaattagacttcaccccatttctttcataacatttatcacaatgacatgtttattttgtgggggcgggtggcattctggccagaactgtcgacttccagagtgaaaatacggaagaaccaaataaaacacaacacacacatttgcacagcagctcgagggaggtgcttagttctttgagtttccaagaacagagagacgaagatttgtctggggaggaaaaatcagggactgcttcttggaggaggtggactgttgctgccccatccacccacacatttgcagatgtggtgatgagaagatgactgtcacgaggtctctgagcccagggggcccatggttgagtgcaaagatagtggggttgacaaataatcgtcgtataacaaaagaaaagccaccacagttgcataatggaaaggcggcttctatagaacattcagatcatagttgaaggcatgtcacactgtgttactcagaggccactgtcagagccaaaagtgagagtggatgagagtttgggcaggaaacaactgaaccagatacagcatcacctccatgagggctcagctttatctattttgtcttctgttgcatccccagcccttagaacactgcctggtccatctttgctgtgtgaataataataaggaacgatcgctgtgttgagtttgggctgtgaattcagacagtttgctgctgcatacctgattatgagtctcagttttcctcctccataaaatgggcaaaacagtccttgcctcatggggctgtgcatttgtttagcaaacactgaaggagtatacatggtggccaaggcactcttcaagacacaggaagcagacaaaagtccctgccctctgggagcttacatgctcatggggagagatgtatgataagaaacaaaaatagtaggtaagttgcatagtactttagaagattataagggtaatgggaagagaacagcagagaaagggctggggaggcagttgctgtattagatagagctttatcgaggcgatggcattggagccaagacttgaggaagctgtgaggatgtctagagaaagaaggaacagctggtgcaaaggccctgaggtaggggtatatgtgacatgtgtgacagtgaggaggcagatgtggctgaagccagtgagcaagagagagggaaggtgcaaggataaggacagagaggtgacgggacaggttttggagggccttatgggctgcggggaggactttggcttttgctctgagggagctgggagccacggagggcttttgagcagaggagggacgtgacctgactcagatattcataggctcctctggctgctgtgaaaagaacagactttgaaggttgggggcaggcagggcagaagctggggaattaggaaggaggtgacagtgttggtcctggcaggtaatagtgggggtggaaccaggttgttgtctgtggagataataatgagtggctggattctggttataatttttaagtttttttattgtgataaaatgaatttttttattgtgataaaatgaaatttaccactttgaggtgtgcaattccacagcacttactacagtcaccctgttatgcaacagtcacctctatttaatctcagaacatttcatcccccctaaaggaaaccctgcacccattagtagttacttccagtttctcccttcccccagcttctggaaactactaattctggatataagttgaaagttgaccagtaggatttctaggcagacaggtggtgagggctcaatgcattcatgcacagaaagtactcaggtggcatatcataggtgctcaaaactgaaatggtgatgatgagttggcaatgatggtgagtccttccagaatccctgctctagtgctaaactgacctacctggctgtgtagaattctcacctgctggccgggagggtggcagaaccaggatcccttcttacttccagtctggcttgggttagggataggggaggaatgatcagaagaaccaagctagcaccatctgttctggaacatcatccaactcttgtccagatttcccagaactgagcaggaaaatgtccagggaggaacagtgcagctgatggaagtcctggtaagccctggccccagcttcctgagctgctgttgcaccaactagcatttgttggaccttcagtctgagccaagatggcagcttcagaggaagaacaagaagtgtacaagtttctttcatggttgtgtccccgcctccttatatagcctcatataaacccctgcactatcccgttactgtttgcctctccctgaaaagagtgtaaaactcccccactttttccctacttttcacaatgtgttttggtttctaaagatgaaactcctttaattatgttctggttgtaattttctggctccttttatttctcccttacttgatgtattattttcccttgttccttctgccccctgcctccattgatgtttctcttcactgctatctagatttaattctcaactcctgccaagttcagggtgatagtgcaaaaagacatggaccatttagtcttgaattcaggtcccacttctgacaccttcaaagctgctttactttgggcaagtcatatgatcttcctgagggggtatcctttaccttgttcagctaacatttcttgtttttctctgggcacagagtagagtgtcattttccccacctccctgaagttaggtatggctgtgtgatttggtttcatcaatgaaatgtgaggggaagtgacgtgagtccttccggacagaagccttaagggtgagcatgggattcaccatgtttcctttttcctgcctccactgtcatggatgcacaaagatggaccctctctcaaagtaagtgctggagagaggatgacatagatcagtccccatcccacttcatagcatgagtagaaaaatagacctggggtgtgttcaaccactgagatctggggattgtttgttactgcagcaggacatagactaggctgactgtatacctcattatctgcattttggggctgatatctaatcacagtgtctccaggaagattatgttgatgtatgttttagggatggatattcatattttcctataagggctcaataggtttggaaatgtcacatgcatgtaaacttctgattaacaaatatttcttgctttccaatttcttcctatagtgcttctaattttcctgtttttcaatcttgaataaaatgtgagaagtgtttgacttctccttcgaggagattaatggtttctaaagcctggggcattgatttagtcattctcaacctccttgtttctatgacctttttttctccttctctggtcacttagtgtctgctaaggggtgaaggaatgtctgttttaactcattgcattttttttttttttgagacggagtctccctctgttgcccaggctggagtgcagtggtgtgatgttggctcactgcaacctctgcctcctgggttcaagtgattctcctgcctcagcatcccaagtagctgggactacaggtgtctgccaccactcccggctaatttttgtatttttagtagagacggggtttcaccatattggccaggctggtctcgaactcctgaccttgtgatccgcccgccttggcctcccaaagtgctgggattacaggcgtaagccaccacacctggcaaactctttgcatttttaactcttgacatcttcatcttctttttcccacctcccctttgcctgttcctcccctgctcaccccaccagggagtttataatcaggttctagaacctgcaatgtttttctgttgttgtcttccatcttccttgagtcttatgggaatcggccatagtcgcaaattaacaaatagctctgaagcgcctcaagcttggaggcatttccttttgctcacctaagcaagatcctggagctgttgcaaatatcctgccccctactgtaaatctgtcttcatggttgtaagagattcagtcggggtcagtgaagacccgagcaggagatcttggccgaggctccttgatgttctgtctgcgctgggtgttgtcatattgattaagctcctgggactgctgccagcagcctctaggattaaatcaatagagtttgcaaaagtaaaagcttcttttggagacacagaatatgtgggtttattttttaatgataaagcttcaaggagaatcttcatggatggcagaaccagtgatggaaaaggcgaggcagacccaaatatttggggaagtgcagtggggagcaagtgagggaggtttcattgggaggccggggctttccagaaaatctgtttaactggagttgctaatgcaacagctcagagttagaagtgaaggtggaagatgcaagaaggactgccgctgagatgtaaagagaaatgaaggagaggtggatccatttgctcattcaataaacattttgggaggcaggggggtgggggggagcctgccatgtgcctggaactgggatgtacatggtggggacatgacagtgggcaggacagatgtggttcctcctggccctcctggaacttgtaacaggaaaagaaggcataaaataaggaataggcaaatacagacataattactaattgtggtaagtgtttgggagaaaaccagcagggtcctgtgtttgtttcctagggctgccaggacaaattgccatgaactatatggcttaaaacaacataaatatattgtcacccagttctgaaggctggaagaccaaaatcaaggcatcagcagtgctgagctcccttggacggctctagagaagaatgcttccttgattcttccagtttctggtagttgttagcatacattggcttgattggcttgtggctgcatcactgcagtctctgcctctgtcttcacatggccttctccttcatgtcagtgtcttctcttcctcttctctctctctcttttttttttttttgtcagggcctcactctgtcaccctgtacaagagtacagcagtgcaattatagctcactgcaactgctgcttcccagcatcaaacaatcctcccacctcagcctcctgagcagctgggacttacaggcgtgcaccaccatactcagctaatttttaaatttttgatagagatgggatctcactatattgcccagactggtcttgaacttctgggctcaagtgatcctccctcctcagcctcccgaagtgctgggattacaggtgtgagccactgcacctggcctcttctgtctcttataaggatctttgtcgatggattttgagcccgtcagataatccaggacaatctcatcttgagatctctaatttaattatacttgcagaggccgttttactaaataaggtcatggccagaggctccagaggctaaagcatgggtatgattgcaccactgcactttaggctgggtgacagagcaaggccccatctctgaaaaataaaataaaataagtaacctactacaggccctttgcgtagaggataattagaagtacaggggtaccacgtaagtgaagacctgaaggttgttaagcacagagcagagtgtgaacagaatgagacagagggaggaagagaatcccaggcagagggaacagcatgtgcaaaggccctggggaaggaacaagttcatcatgttaaaaatgagccagtgtagctagagtctgatgagcaaagggactcacaggtgggaagacacccaagaagttggcagagacaggtcacacaagaccttctaggtcaagttccggaggtgaactttattctacatgcaatgagaagtcctcagagaagcttaagtgggatgggacagaactgctttactttaaatatatatacatatatacaaacatataatattacatatataaagcatatatatgtatacatatatacatatctatctacctgtctatatattttttagctgggcatggtggctcacacctgtgatcctagcactttgggaggctgaggtgggaggatcacttgagcccaggagttcaagaccagcctgggcaacatagggagaccccatcactacaaataaaaataaaaattaaaaattagctgggtgtgatagtgtgcacctgtagtcccagctacccgggaggctgaggtaggaggattgctggagccccaaaggttgaggctccagtaagccgtgattgtgcccctgcactctagcttgagcaacagagtgagatcctgtctcaataaaataatttttgtattgaggtgaaattcatgcaacataagttaaccattttaaaatgagcaattcagtggcattcagcgcattcacaatattgtacaacctccacctctttctagtgctgaaatattttcatcaccacccctccagaaaaccctgtatccatgaggcagttgctcctcatcctcccctcccggtatccccccaacccccaccactcctggtaactacaaatttgttttctgtttctatggatttacctatactggctctttcatataaatgaattcaggcactgtgtgacctttcgtgtctggcttctttcacttagcataatgccctggcttctctctggagaatgaaatggatagaccactttggagtctactgagattatagatatttctgtgggaagggacagtggcttgaccttgggtggtgctgaagaggcaatgctgagcaggaggattcaaagtctaatttcggaagtagaattggtggggtctgatgatacatcagctgtagggggaggaagatgtaggaactgggaaggtctcttagggtaaccttacctgattgagctccttactaggcagctggtggtacaattcataacaaaggttaatagagaaagagacatgggattagggagggaatggaagagtttgggccttggacactgtagtggtttgaatcctgtccaccaaaaattcagatgcatttggaacttcagaacctgagacctcatttgaaagtaggatctttgcagatgtcattgagtcagggattgagatgaggtcatcctggattacagtggactcgagattccatggtaagtgcttttatatgagaaggtacaggggagaaagtcatgtggcaatagaagcagagaatggagtgctgcagccacaagccaaaagacatgtagaggcaccaaaagcgggaagaggcaaggaaggatcctcccctagagcctttgaagggaaaccccctaatttcagaaccttgcctccaggatgacgagagaataaatttctgttgttttaagccacccaatctgtggcaatttgtcatgactgccctaggagactaatatagacactcctatgagatgctctaagaagacacagagtggtatagctattgctaagaccacacactgtagcagggaggaaatcaaatggagaaatgccccaactccccctcctctctgatctcttgctggtgcctcccgttggccaagccaacccagaaggcagaagatgtggtggagggcagcgttgcagggcttggatgatgcagtcacagaagtcagccctgcctctaccaggatgccaaacagggcaatgagtggatattttagggagaaagggcaacaagagaatggcaaaatacatcgaaatgcatgcaagctctagaaagaggatagagatagataaagggtgattacctaggattaagccccagggaagaccaacatttagagattggatagaaaaagaggagcaaaaagggaagattgagaagtagagaccaggaggataggaggaaaactagaacaacattaagaagggcatggtcaagtaatctgggcacagaaaaatggccctgggatttggcagcctgggggtctttggtgatcctctttggaagagttttggttgagtgatgggggctagaaaccagcctggggagggtaggagaagaatgtgcagtgaggaagtggcaggaacacgtgaaggcaactcttcatgaaggggagtagagaaattggttggtggctgaaggaaaattttcagtcaagggtggaggttttaatgatggaagaatattgatttctgtaaattgggtcattcccatccattataccaatatgcacgggtgtcttctctgatataggatgctgggattctcaaatgcccatttgagtttagcatcatgaatttaatgtcaccagcccagatagttgatctcattcaggaatgctccactgcccaggtatggggaaggcaactagttgagttcatgcagggatggattttttccaggagagaaacaggaggcaagaaagtgcgatataatcaacctatgtaaggttgacaaggcaggagagggtcctgagaaatggcggggtcagtgggttgcagggctcgatgggatggacgttggtttgcatttaagggagttagtgagctgggaggtggttaaagaggaggtggttcagccgggcgcggtggcccacacctgtaatcgcagcactttggggagccgaggcgggcggatcacaaggtcaggcgatcgagaccatcctggctaacacggtgaaaccctgtctctactaaaaatacaaaaaaaaaaaaaaaaattagccaggcgtggtggcgggcgcctgtagtcccagctactcaggagcctgaggcaggagaatggcgtgaacccgggaggcggagctgctgtactccagcctgggcgacagggcgagactccgtctcaaaaaaaaaaaaaaaaaaaaaaaaaaaagaggtggttcaagacaaggatgctggaaacaggtgttttggaggtggctggtgtagcttctgagcatgcatagctggagtggcttggaggagacattggttattgatgaagaggtagggacatcctccagtgatcaaggaagcaggggaccagcatggacaatggtctctccacagggaaattggaggtcatcaaatgttaacaggttccgtcggagtcttagctcccagcttctgttttcctgtggatctcaggatcttggctgctggtgctacctctgactttggacttcccattgagcccagcagcactgggagggaccttcatggcattggctggtttaaggaagacttccttggctttgctgactttcttgggggccttcttggctacacctgcttttgagggagccctcctcacctcacctgacttcttgggggcaccttttccaccttatctgagttgggaaggtctttctttgattctcttgctttcttggggcccttctcactggtttttctgggggccatgatggtggacatattccagagctgagctttccttttgttcttaggaactaatttgaggctgccagtggccccaccttggtcttagagttgatggtctgcagggaatttccaggttaaaggttttttatttgtttgtttaattttgagacagagtcttgctctgtcacccaggttggagtgcagcggcacgatcttggctcactgcagcctccgcctcctgggttcaaacagttttcctgcctcagcctcctaagtagctgggattacaagcacgcaccaccatgcccagctaacttttgtatttttagtggagacagggtttcaccatgttgaccaagctggtctcaaactcctgatctgaagtgatccggccaccttggcctcccaaagtgctgggattacaggtgtgagccactgcgcctgacctccaggtttaagtttaaaccatgaagtagatggactgtgtagagagagaccagggaaatggaggattttactgaccactgaacagggatgtcactattgccagagaggaaaaggattcccccttggtagagtgaacatataagggaaagtggttgaaaattgaatcaggagacagagacctcacaccactcagaggtccctagagaactttactgacctagaaaaaaagataaacagggagaaggtcttcagttcttgtttggaatctgacactgaagcatcctcactcctcactctcttcccgaccccgagagtctgaaattgattaatactttttgtttaaaacttggcttgttgttttgttttttctttctgttttcatcaagggatctttattttacttttgtgtatttgtgtgttttccatgagtcatgttaattcttccatgtttaaactttttggcccagaggaatttatacatttaaattatggatttaatttcagaaggtacatacacacacacacacacacactcactcatctcactttttaaaaactgtaaaatatagccctgtaaatatccagaaaatatctaatgtgggccgggtatggtggctcatgcctgtaatctcagcactttgggaggccgaggtgggtggatcacctgaggtcaggagttcgagactagcctggccaacgtggtgaaaccctatcctcactaaaaataaaaaaattagctgggcatggtggcaggtgcctgtaatcccagctactcgggaggatgagacaggagaatcacttgaacccaggaggcagaggctgcagtgagccgagatcaccccactgcgccccagcctgggcgacagactgagactctgtctcacaaaaaaaaaaaaagaaaagaaaaagtcagtgtgcatcccctctgacatccagcaacttcacatcttggaatttatgctgcaggaaaattatcacaagtgcacaaggatgtatggtgagatagttattattatcattttaaaagatagggtctcactgtgtcacccaggctggagtgcagtgaagtgatcacagctcactgcagccttgaccttctgggctcgagtgatcctcgtgcctcagcctccccagtagctgggattacaggtgtgagccaccatgcctggcatccccctttttttaaaaaaaggttttaattatgaaaagaatatgggcttgttgttttgtgtggttttttaaaagcttaaaaaatgtgtagtgtgtcatttagaaggtgaaaagcccttaccccatcccacctcccagagataacctctgctagcaatttcgtgtttgtctttcaaattttttcccacacacattctttgtactggctgcttcccctcctgggttactcttctcccagacagaaacagggctcattcccttgcctcctccagcttttattaaaacattaacttccctgtagctggatgcagtggctcacgcctgtaatcccagtgttttgggaggtggggaggcaggaggatagcttgagcccaggagtttgagactagcctgggcaacatagcgagacccatctctacaaataaataaataaataaataaataaataaataaataatggaaatttaaaagagagagggaaggactcttgaaaaccgtccatatcatgcttctctaaatggttgagggctcagaggaaaaaaaatcagcaatttcacatcacggaatttattctgcagaaaaattctcacaagtgcacaaggatgcgtggtcagatgatgatgatgatgattattattattattattgaagaaagtagcagcagcagcagcagtattttaaaagacagagtctcggatgggcatggtggctcacgcctgtaatcccagcactttgggaggttgaggtgggcagatcacttgaggtcaggagttcgagaccagtctggccaacatggtgaaaccccaactctactaaaaatgcaaaaattagccaggtatggtggtgggtgcctgcagtcccagctaccagggaggctgaggcacgagaatagcttgaacccaggaaatggaggctgcagtgagccaagatcgtgccactgcactccatgcactccagcctgggtgctgacccaggttaggtgcaagactccgtcttaaaaaaaaagaaaaggaaaaaaaaaaaaaaaggacagagcctcactgtgtcgcccagggtaaagtgcaatgagtaaaggcccatgatgggaaccctgaggagagagtcaaggggaaagaaaaaaaaaaaagcaaaaccaaaatggaatttaaaaaaaatcaggtgcaatttgcataacagaaaattaaccattttaaagtgaacggctctgtggcatttactgcactccaactgttatgtaactaccacctctgtctagctccagaacattttcaccacccctaaaggagaccttgtacccattaagcagtctctctccttctcccctccccaccaccttcctccagcctctggcaaccacccatctgcattctgtctctatggatttacctattctaggtagtcaacaggatgagatatcccaaaagtccatccatggatgaacagataaaccaagtgtgatatgccttcctcagatattagtctgccttaaaaaggaatgaaatactaatctttgctacaacatagatgaacctcaaaaatatgatgtggctggacacagtggcttacacctgtaatcccagaactttgggaggctgaggtgggcggatcgcttgagcccaggtgttcaagaccaccctgggtaacatagcaaaactccatctctacaaaacaatttacaaaaaactagccaggtgtggtgacatgtgcctgtagtcccagctattcaggagactgaggcgagaggatcgattgagcccaggaggccgaggctgcagtgagccatgatcataccactgcactccagcctaggcaacagagtgagaccctatctcaaaaaacaaaacaaaacaaaacaaaaaagttgatgctgagtgaaagaagccagacacaaaaggcaacatcgtgtttaattccatttacatgaaatgtccaatgaagattttttttggcaacatttattttgagtataatattcagtgagtggaccacacatatgcatgcactgcagtatgttcttggaaacatttcagatttgagaggtctgttcagctatgatgacggtaggtattgtcccttccctccctccttgaagaaaaggaactaaggctggacgcggtggctcatgcctgtaatcccagtactttgggaggctgaggtgggcagatcacttgaggtcaggagttcaagactagcctggccaacatggtgaaaccatgtctctactaaaaaatacaaaaaattagccaggtatggtgctgcacgcctgtagtcccagctactcgggaggctgaggcaggagaattgctcgcacccaggaggtggaggctgcagtcaaccgagattgcaccattgcactccagcctgggtggcagagcaagactctgtctcaaaaagaaaagagaagagaagagaaaagaaaagaaaccaaaagaaaaggaaagaaaagaaaaggaaccaagacctagaagggcaaaaataggaaaagttggccgggcgcagtggctcacgcctgtaatcccagcactttgggaggccaaggtgggcagatcacaaggtcaggagatcgagaccaccctggctaacacggtgaaaccccgtctctactaaaaatactaaaaattagccgggcgcggtggcaggcgcctgtaatcccagctactcgggaggctgaggcaggagaatggcgtgaacctgggaggcggagcttgcagtgagccgagatagcaccactgcagtctggcctgggcgaaagagcaagactcggtctctaaaaaaaaaaaaaaaaaaaaaattggaaaagttatttactattagcagcaattgtcataaagtaatgaacatttattgcatgattacaatgagataaattgtatcctgtttttataagcatattaagttttcttttttaaaaaaatgtatgtatttatttattttaagagatagggtcttgctctgttgcccagactggagtgccatggtatgatcatagctcaatgcagcctcaaattcccaggttcaagcaatcttcttgcctcagtctctcgagtagctaggactacaggcatgtgccaacatgcctggctagttttcttatttttaaatgtatttttgtagagacaggatcttgctgtgtcgcccaggctgtcctcaaactcctggcctcaagcgatcctctgccttggcctcccaaagggctgagatgataggcatctacctctgcatttggcccacattaaattttctagtcatcatgggaaccaaaataaacaatataaaacactcacattccttgagcacttactatatgcagggccctgtaatagattattgtgtgtatcagctcattccattctcacacaacctatgaggttgatgctattttctaccttttatatatgaggaaactgaggctcagagaaggaaactgccttgcccaaggtcaaggccacgtctgatccccaaatcctttcaactcctctgcactactattttttagtgcagatattgccagttttctaagcagaagcatgatttagcagccctgagtagacttctcatttcagaaccaaagtgttggacattgttggataatatgaaaaacaaatgacacacaaacctatttgatactgtttttaattttctcttcatttgattttcctgatgacatgattaatcttttttgcctctaccctgtatgtgaaatgtaggtctttgcagatgtctcagagagtgttaatagttgctgctggttttgttttctctccccggggattcccatccctgggtgcaagtgaaattaaacttgtgcctctttgccgctggccgtggtgctgaaaacatcccgggcagcgctagggttgcccttgttagcatgccatccctgctaagagtcttaggctgatcagcgagtggagagatcttttccaggcttcattttggttagaactgtgtgttgaagattttaaagcccatgtctgggaactggagactgtttggattgtttgaagttgaaatagtcatgaataattcctacttgagatgggcttatgagggcgtggactagcatgcaatggttggcctttactaaactgtggccattggttgggacttgggtgaggtgtaacccatttggtctaatccatatggttagggccccaagtgcacctgcattctatttttttttttttttaaataaaggcaaacccatctatcttctaaccaggatagctcctgagtggtctttggggaccaccagcttaaaagcatagactgtgggctgggcacagtggctcatacctgtaatcccagcactttgaaaggccaaggtgagaggatcgcttgagcccaggagttcaagaccagcctaggcaacatggtgagaccctcatctctacaaaaatgttaaaagttagccaggtgtgttggcatgcacctatagtcccagctactcaggaggctgaagtgggtggatcgcttgagcctgggaggtcaaggctacagtgagctgtgatcgtgccactgtatttcaccctgggcaacagagcaagaccctaactcaaacaaacaaacaaaaaaaggcatagactgtggagttgggcagacctgggtgtgagccccagctctgccagtacctcctatgtgaccttgaaaatttgtttaatctctctgagcctggattttcttgtgtggaaaatgaggcttaccacagaacccaccttgtagaaatgttgcaaggaattaactgaaacaaagtgcttaccacggtatctgcccaaagaagcagttggaaacaaggcagctgtaattatggtcgctgtgcttgttaatggccccataatagttgatcatattgcagagtgaaattggggtatgtgtttaatggaccaaggaatatgtcttaaacccatatatctagggttctggtaccctctactctttttcctggtgattgtgatgagcatggaacttacatgaaaatgaggtctgtttggcttcttcacacaagctcaatgacctggctaactgctacaagtatctgtttccttagaacccacccatcagcagtccccatagtggagacaaggtcacaaagagttgacaaacctgatttgatttccgcaccaaccacaggaggcttgaaatgagatgagggtgaagggcaccacagagggatgcaaggattacttggacactgcaaggtcttgctaagggatgggaaccatcagccacgcccactttgagaattttccttcatgttctgaatctgaagagcaaggtcctgttctcagatgcaagccctccttcttccctacgcagagtcaaacttggtcttttccagggtcacatacagcctctctctggggcctctgcaggtcctgatcaatttcattgtgtatagagctctgtgtctcctcacctgcctgcagggctgtctgctatcctgacttccgagagccatttcggaagccagcttttcctcccatcagggatgcttctcttctttcagcccccgccccgctttggcctcctaggatggctgatttttctggatcccgctgacacaggtgctttctctccgagccaatcagggagcagaaaggctcagctcagctaacagaggcattgctcaccgcagctgtgagttagaactcaggctttctaaatcgggaggatcaggcatgacttgaggttgggctgagaaagcctcgcctgccccccagctcgactacccagtgaaacctttggcttctgcctcgggcgaggcatctcttaccatgccaagaactcagcagcccatctttctttcatctgggcaccaagtacatcattgcatatttcagggggtttcattgtgtccttaacatgctcatggagacttggcttgagatgaagtcggggtttctaggcagcaggacccatgtccccttccttcatttcctccaccggtgatttttgttttgttttgttttgttttgttttgttttgttttgtttttgagacggagtctcgttctgttgtccaggctggagtgcagtggcgttatctcggctcactgcaaactctgcttcccgggttcaggtgattctcctgcctcagcctcccaagtagctgagattacaggcgtctgccactatgcccagctaatttttgtatttttagtagagacggggtttcaccatgttggccaggctggtctcgaactcctgacctctggtgatccacccgcctcggcctcccaaagtgctgggattacaggtgtgagccaccgcaccaggcccttccactggtgttttttgagcatctactatatagagaatgctctcctgggcacagaggatgaagcagtgaacaaagtagacaaaaaatccccacgtgcatagagtgtgcagtctcgtgggagagacagggaacaagataaagaaggaaaaaaatagcagatgcttgactggggacggggactaaagaaagaaaaaaataagcaggctaagggggttgatggatgtgacctttgagtaaaggcctaaaggaagtgagggagggagtcatgtggatgtctggggaaagactattccaggagaatgaacagcaggtacaaaggcccctgggtacaaatgtgcctggggagtttggggaataaaagggaggccggcgttgctgtagctgagtgactaagggagagaatagaggagatgaggggagggaggtaatgggagcaggtcatgcaccttgctggtgctggaaggactttgtttttgcttttgagtgagatgggatccatgggaaggctttgaatacttccacatgcattaggctgaaattttcttttctgcttttgtcgcattccaacattgcttttatttcatcaaaatcttcggtttcttctcaggctctttacccaagtgggagcagaaggctggtacccagggctgttcagttctccccctggggtcagaacgtggaggagaaagcttggaggagaaacaggaacccccacctctttctggatgactcaaaaccgcaattacctgagctcctcctcctatccctgaaatagaggcacttagcacttcctaaacttcccggtgcacacaaatcccctggcgatctttttaaatgcaggttctgactcagcaggtggatgcaaggtctaaggctgcattcctaaccggtgctggttctgggaccacactttgagtagcaagggtctgaggtcattgttgcagatgtccatctggggcatgtctgtggacacttgcgggggtgcgggtgagcagagggaggggggatgatgttggaaaagcagtgtgagtatctgtgtttgataagaagtaagaaaatgaagcaaggtgggagagtagaacctctttatttttgcctacgtgctaaggttttattgccatacccagagagccctgggtctgaaatccaggcaacactggccagttgaaaccctgatattgcagcccataaaagtgctgcatgctgcatggtggacttctgggactcttcctggaaccttcagtgccagagccggtccaaaggaagtcacatccctgccattgaggggcaggagaccagggaaccggaggagtgggatggcagaagcgcgtgtaaggaggctgagttggcagggagagaaagcgaagtcagcttcaaatcatagcgagaggagaccagggaagggcttggcgttgctgctctgtgtacaaatattgtctcttattttccaggctgcagggtgaggcagagtggagtatttgtgcaacacagcccagctttgttctctgggctcctaatgcctgtcagctcagaggcagaaagccaatcagagatgatcgtcggcaaggccggcttttgttggctccccaaattgccctgagtctcggattttgcttttcagagtgtgctttcagctggaggcaaaggctgaagctggtgacaaaaggaagcctggttttcctggctttccgagacttttactgagggggtttctatttcagactccgttttcccacctggaaagcaggttccactctccctccggcctggaagggatggttttatggtgcttccaaaatgccaaacctaactccagggcagaagaggagactgaaaccaattaattttccaaaggttagagctacgaggaggggagaggtttagcatggtcaagttccccaagacatactaattgatctctctacagaatgcgggatttcagtgcccccaggggacactcagcaatgtttagagaccacttgaggttgtcatcactggacaggaggggctgctactggcatctagcacacacaggccagggatactgttgaacatgctgcagtgcccagacagccccaccaaggagaatgatccacccctaaacctagtgctgaggttgggaaatcctgctccggagtaaccaacaccctatggctttttcactcaagcagccgcttctccagcgcttacacctcctcagagattgccagatccatatgcagagcctgttggcgtgggacacttctgaggggtgtggcagggagacagcggacattcccatttaccagctgatcagcaggttaggagctaatatgaaatgaacaagatagaccctccccacctgccctgcagatcctctggtgggacactagggagggaggcctcctaaacccaaatgacagttcccaggatgcagggaggagtttacctatgcaaactggagagaatgcaaatggggcatctagagatacttactggacgacccctcccctgcctcgggtcttggaagaacagattctcagaggtctgccctgatcactgtaattttttttttattgaggtaaaattaatataacacaattaaccattttaaagtgacatttagggctgggcacagtggctcatgcctgtaatccccgcactttgggaggctgaggaagaaaggtcgcccaggagttcaagaccaccctgggcaacaaagtaagactctgtctcttacaaaaaaaaaattaggcacacatggtgttgtgcacctgtagtcccagctactcaggaggctgaggcaggaggatcgtttgagcctaggaattcaaggctgcggtgagctatgatcatgccactgcactccagcctgggtgacagagcaaaattgtgtttctttaaaaaaataaaagtaaaaataaataagaaaagaaaggagaggggaggggagaggcgtttagtacactcacaatgttgtgtaactgtcaccttcatctagttctaaaacattaagcagccactcccatttcccttgccattccccaggaacaacaaatctgctgtctgtctctggatttgcctgttcgggatatttcatatacatggaatcatacaatatggggtattttatgtctgcttctttcgcttggcataatgttttcaaggttcattcctgttctatcatgtatcagtacttcattccttttttttttttttttttgaaacggagttttgcttttgttgcccaggctggagtgcaatggcacaatcttggctcactgcaacctccgcctcccgggttcaagcaatcctcctgcctcagcctcctgagtagctgggattacaggcatgcgccaccacacccagctaattttgtactttttttagtagagatggggtttctccatgttggtcatgctggtcttgaactcccaacctcaggtgatctgcctgcctcggccttccaaagtgctgggattacaggcgtgagccactgcacccggcctacttcattcctttttatggctgaatactattccattctatgagtagaccacattttgtttatccattcacccactggtgaaatttaggttgtttccatcttttggctgttgtgaatagtgctgctgtgaatatttgtgtatgagtgttcgttggaatacctgtcttacgatccttttgtgtttataccttggagtggagttactgtgtgtcacatggtaactctgtgattaactttttgaggaaccaaggaatggttttctatggcagttgcactggtgtttttttgttgttgttgtttttgttgttgttgttttgagacagggtctcactcccattgcccaggctggagtgcagtggtgcagtcatggttcactgcagcctcaacctcctggggctcaagcaatcctctctcctcagcctcccaagtagctggcactacaggcctgcgccactatgcccggctaatttttcatattttttgtagagatagagtctcagtttgttgcctaggctggtctcggactcctgtgctcaagtaatcctcctacctcggcctcccaaagtgctgggattacaggcatgagccaccgcatctggccagctacaccattttatattcccaccagcatgagggtttcaatttcttcacatcttcaccaacacttgttttctgtttgtttgtttgtttttaatagctatcctagtggatgtgaagcagtatcccgttggggtttgatttgcacttccctgatcactaataccctcatgtacatattggccatttgactgtcttctttggagaaatgtctattccagcctcctgtccatttttcaattggattatctttttgttgttgtgttgtaaatgttctctctttattttttatttttttgagacagagtctcgctctgtcgcccaggctggagtgcagtggcacgatcttggctcactgcaagctccgcctcccaggttcacgccattctcctgcctcagcctcccgagtagctgggactacagatgcccgctaccacgcccggctaattttttgtatttttttagtagagatagggtttcaccgtgttagccaggatggtctcgatctcctgacctcatgatccacccgccttggcctcccaaagttctgggattacaggcgtgagccaccacacctggccgtaaatgttctttatatagtactagacccttatcagatacatgatttgcaaatagcttctcctattctgttacttgccttttaactttcttgataacgtcctttgatgcacaaaaggtttaaattttgataaagcccagcatatctgttttttcttctgtggatcatgcattaggtgtcaaatctgatcataatgttttatttatttatttacttatttatttattattttatttatttttgagatggagtcttgctctgttgcccaggctagagtgcagtggcatgatctcggctcactgcaacctccacctcccaggttcaagcgattctcctgccccggcctcccaagtagctgggactacaggtgtgtaccaccacgcctggctaatttttgtatttttagtagagacagggtttcaccatgttggccaggctggtctcaaagtcctgaccgcaagtgatccacccaccgcagcctctatctatttttaatttatctctttttttttttttttttttgagacagggcctccttctgtcacccaggctggagtgcagtggtatagtcattgtacactgcagcctctacctcctcggctcaagcaattctctcgcctcagcctcccaagtacctgggaccacaggtgcctgccatcatgctggccctgccaccatatttgaaattgcagccctgaccccttccactgtctatagtcttcaccatcttactacataacatagcatatatgatgtactgtataacatggtatatgcagtgtactgtatagcatagtatacatgatgtagtcatctcatttatttgcttctcctctgggaagcaggaggaagcttctcctcttgtctgctttgctctcaactgtgtccctagcccagaacagagtctggcacacagcaggtactgaatgaatatgtgttcagtgaatattgtgggtgagatagaaggtgaatatccacatttccctttagaagtcacctgatctgggtttgagatctgcagggatctactccagacaggagaacgaataattccacctgtgctgatgagttggaaggatctagagggcttgagatctttccactggggtcagtgggggtgggtgcacctccaacacccttcttttctttgaacaagatttttccttaattccccaatactccctttgaatatatgattttagccaccatcatagcgaattgcatcgtcctcgcactggagcagcatctgcctgatgatgacaagaccccgatgtctgaacggctggtgagtgatgtcttttctcagggtcttctccttggctttagcaggacattaatttttgggggagtggagcagggcacagaggaggctctcagtcctggagcccagagccagatcatgggaagcctaaatttccttttcattttttcttgaaccagagtctcgctctgtcacccaggctggagtgcagtggttcagtcatagctcactgcagcctccacctcctgggctcaagccatcctcccactgcagcctcctgagtagcagggactacaggtgccaccatgcccagttaattttcttatttttatctttttttgtagagatggggatctcactaggttgcttaggctggtctcaaactgcccactttggcatctgacataatttcaggcagtatactcaaatgaacattgttaatgttaataattatgtcttggccagacactgtagctcatgcctgtaatcccagcagtttgggaggccaaggcaggtagatcacttgaggtcaagagttcgagaccatcctgaccaacatggtgaaagcccgtctctactaaaaaaatacaaaattagctggatatggtggtgcacacctgtaatcccagctacttgggaggctgaggcaggagaatcgcttgaacccgggaggcagaggttgcagtaagccaagatcgcaccattgcactccagtctgggcaacaggagtgaaactccatcttggtgggggggaggcgaaaaaaaagaaacaagaatattacaaaggatacagatgaagagatgcaaagggtgagatataggagaagggtgtggctggcagcttctaggtagcttcaggagggggactggtcaccagaaagaccaaggcatgattcgagggttgcgactttcagccccaccccccaacctctgggagggcagaggggctgaaaatcaagttgatcaccaacggtcaatgatttaaatccaaacctctaatcatgccttggttttcccggtgaccaacccccatcctgaagctacctagaagctgccagccatcagtcaatccttagcctgcaaaaagacatccctttggagatcccaagggttttaggagctgtacaccaggaaacagtgtcaaagaccaaacatacatttcacaatgtcacagtcttctaaaaactataactagcctagcaaacctatgatttctagatctttgcattttcacttaaaataaagctaaataaaaagcgtccattgaaagactggtaagcaagtagaagtaccagtggcaagctaatgtggaaaaaaaaaatcattcaggcagagtgaaaatgattgtagctcgagaaacgttgctgtaacagatgggaaaacattcacattggggctctgatggagaagagcttgtagcttaatttcaaatatgatagattagcagctggaagccagaaccagccggaggttctgcagaggaactggaggtgaggatactggccacttatcagccagtacagaagtcctattccaaacctttaacaatctacatgccagctgagaaccatcctaaggggtcagatttaggagtgaggtcaatgcacaagctctagcctcaaataccttgaacgctgcatgtgacaagtaaattctctaaaccaatgctttccattagaactttctgcagtcacagaaatgatctccatctgccctgtccaataggattgtcacttgaaatgtagccagtgtgactgcagaactgtgttttttattttattgcatttaaattaattttaattgaaatagccacatgtggcctgtgactgtcgtattgaataagacaggtgcaaacaaataattctgtttagctgagtgatatgtgaggttggcccaaaaggaatgaaggaggaaggtgccttctctaggcattggctttgctcgcaaaaggctttggacaagagaactctgcaagaggcagtgaggggtggtgagtgcaggagggtcaggggaagtgagagggtgataggtactgatttctaggtgggctggttccctgatcttgtcaacatctgcccagcccaagacgctgaccttgccttctctcccttccaggatgacacagaaccatacttcattggaattttttgtttcgaggctggaattaaaatcattgcccttgggtttgccttccacaaaggctcctacttgaggaatggctggaatgtcatggactttgtggtggtgctaacggggtaagtggcgcgtgctatacgctttggatttaactagctgaaggattacgaggcttttggttggtgtggtccgggccaggctcaggaaggctgagcccttgtgttctccctccccttgttatgcgcctgcctcctttctgccaacaccccacctccatgtctcagctgtatattacagcagatgctttctgttacaattaaaataatagctcattattgttggctgcttccagagtgctttatgcccattctctaatttaatccttgcaacaacccactgaattaggaaatattaatattcccatctgaccactgaggaatcagaaactcagagtgtaacttgcttaaggccacccagcaagtaagtgatggaactgggagatgaacagaagattatgcattccagaactcaaggttttaagtgttgtacgtgcatgggtctcttgatttgcttgaggatatcttgcttttatttcaacttggtgaatgttttttgagaatgtctgggtgcaagggattgtgattatgacaaaggagaaaagcaagctaaataaggtacagttactgtcttcaaggagttttcagatccatatatgatgaactgtggttgaaatgtgtatatgctttcctctaagcaccctgtatgaggtagcacttgctggtataacaaaagatccaaagctaggaaatgacttaaacacggcagaagtttatttgtcactcatagaaaattcaaaattgagctgggtgtggtggtgcatgcctgtaatctcagcactttgggaggctgaggtgggaggatcacttgagctcaggagttcaagaccagcttgggcaacacagtgagaccacccccccatctgtaaaacataaaataaaataaaaattaaccaggcatggtggtacatgcctgggagaattgcttgagctcaggagttggagggcacagtgagctatgatcatccaaccgtgctccagcctgggcaacagagcaagaccccatctcgaaaaaaaaaagtccaaaataattgttcctagttgacaggctcatctcctccaatgactgacggaccctgacccttgccatattgtggctcttcattgtcagcccacatcatccaataactccatgcttgtctgtatcaaaccaggaaggagaagtgagcatagaaggtgatacttggaaaggtttatgagtttggaaggggtgtgacccatacctgttccattcatatcctattggctagaactcggtcacatgaccacacatcactgcaagggaagctgggaagtatcagattgtgcttagaagaaaagggaaatggatttggagaatgacctactagtctgtcagggaccttaaaaacttttattagattccagtagggacattagtatctggtaccaatggctggttcctcctcttcccactctctactctcctctcagctaagtctgggctcttctattctaagacccttcttcactggacacctttttcatagtaatcatttacaggatcatagctttccatgttttgttgctgctccaggttctgtctctcttggcggatgtgatgggttgcagcacccacactgtgctggccgggctctcacaatgcagatttgtttcagagcaatgttgcctctcacagaaggagctgtggcctattgggctgtttctgtagaggccttcagatgtcagcagtctgttgtaaggactctgggctagctctcatgggcttgggtgttcacagagggatctttgttggctgtgctcacagttcggtggcttgggaccttggtgggttccaagggcatattatggtactgggcacttttctcttagtctactaggaaactcatctagaaacagcctagtggctaacttttttattgtttaaaaaatgtaaagctgggcagggtggctcatgcctgtatcccagcacattgggaggccaaggtgggaggattgcttgggcccaggagtttgagacgagcctgagcaacatagcaagaccacatctccacaaaataaaaattaaaagtgtataaagctgggtacagtggcacatgcctgtaaccccaattactcaggaggctggagagagaggattgcttgagcctaactagtttgagaccagcttgggtaacctagcaagatcccatgcaaaactaagtagagaataatagagcaaacacctgtgtatacattcatttattcaatgactatttattgaacacttctgtgtgccaggtcctgttctaggctctgggacacagcagtaaacaaaatagaaaaatcccctgtcctcatggagctgagagtctactgatggagatggacacaattgatgaatgaatctagtgtgtcagatggcggtgaggggtacagaggaaaaataaagcaggggagggatgggatgtgtggcaggcaggggtgaggggtgctggaagccagggaagacttcactgggcatgtgacatctgaatgaaaacctaagggaggtgagtgagtgagccatgaggagagctggaacagagtgtcaggcaaagggaacagccagtgcaaaggctctgaggctggactgtatctgacatgtttgatcaacagtaagaagacccacatggctagagaaggtgaccagaagaatggggagaattggggatagagaagtaatggagtaacctgctatcaaaacacaacctttctctttttttttttttttttttttttgacaagagtctccctctgtcacccaggctggagtgcagtggtacaatctcagctcactgcagcctctgcctcccagtttcaagtgattctcctgcctcagcctcccaagtagcttggattacaggcgtgtaccacaacatctagctaatttttgtatttttagtagagacgggtttacgccatgttggccaggctggtcttgaactcctgacctcaagtgatccacctggcatggcctcccaaagtgctgggattacaggcgtaagccactgtgcccagcaaaacaaaacctttctaacctttctaatccctgttttctccctccctagacccattcctttctctcccccatccaggggcactttcctgaattttatgtttattatttgcatttatgtattcacactttggctgcctaagtatataagaaatatatgctacctatttttacacttcaaaatattttttaaatagcatcagagtgagaatagtttacactttgactacatgcatagataagaaatatgtgggctgggaatggtggctcacacctgtaatcctagcaattttggaggcaaagatggaaggattactttaggccagaagtttgagaccagcctggccaatgtagtgaaaccctgtctctacaaaatgaaataaaatgtaataaaatattcagctgggcatggtggtgtgctcctgtggtcccagctactcaggaggccaaggcgggaggatcacttaagcccataaggtcgacgctgtagtgagctatgactgcactccagcttgggcaacagagcaagaccctgtccctaaaaaatgttttttgttgttgttgttgttttttgtttttttgtttttttaataaaggccaggtgtgatggctcacacttgtaagcctagcactttgagaggccagggcaggaagactgcttgagtccaggagtttaagaccagcctgggcaacatggtgaaaccccatctataaaaaaaatgcaaaaaattagccaggcatgatgacgcacgcctgtagtcccagctactcaggaggctgaggtgggaggatcacgtgagcccaggaggtcgaggctgcagtgatccgtgattgcaccactgcactccaggctgggcaacaaagtaagaccttgtctcaaaaaaataaaataaaataaaaaataaaaaaaagaaaagagaaagaaaaaaagagatatgtggtactgtttttcaaacttcacatttctctaacctgacttttgtgttcaacatgagataaatctgattaataaaaatagtttccatgcatccattttcatgactgcatagtattctgtggtaggagtatgctgccgtgtatttatctatttggattgtttccagctttgggctattttgacccaaagtgtccctgctttctcccaagtgagtttctctagggcacgtacccaggagtggaactgctgagttgtatactgtgtgcatcctcagccccactaggtattgccaaattgctctgcaaagtggttgtgccaattcatgctccctgggggctggcttctgctggctgaggctggcttgaccttgctggcaggaaggagccttaaaaatccctgtgtggttttttttgttttacttttattttaagtttaggggtacaagtgcagatctattacatgggtaaacttgtgtcttgggggtttgttgtacaggttatttcatcacccacgtattaagcctagtacccattagttatttttcttgatcatcttcctcctcccgccctccaccctccaaaaggccccagtgcgtgttgttcacctctgtatgtccatgtgttatcatcatttagcccccacttagaacacgcagtatttggttttctgtttctgcattagtttgctaaggataatggcctccagctccgtccgtgttcctgcaaaggacatgatcttgttctttttcttggctgcatagtattccatggtgtatatgtaccacattttctttatccagtctatcattgatgggcttttgcagccctgtttttttttttttttcataataacacggttatgggaacacttagggaagctcatatattattgagcagtgtgatggttaatattgagcatcaacttgatcagcttgaaggatgcaaagtcttgttcctgggtgtgtctgtgagggtgttgccaaaggagattaacatttgagccggtgaactaggagaggcagactcacccccaatctgtgtgggcaccatctaatcagctgccagtgtggccagaataaaagcaggcagaagaagttggaaagagtagacttgctgagtcttctggccttcatctttgtcctgtgctgaatgcttcctgccctctaaaatcagattccaagttcttcagcttttggactcatggacttacaccaatggttagccaggagctctcaggcctttggccacagactgaaggctgcactgtcagcttccctacttttgaggtttgaggactctgacggatccaccactggcttccttgctcttcatccttcagatgggctatcgtgggactttaccttgtgattgtgtgagtcaattctccttataaactccctttcatatatacatctatcctgttagttttgtccctctgaagaaccttgactaatacagacacctagtgggtcccaataagtgatcattaaactgaaggcagtcattcagtaggtcagtttgtcacttgtgtttgtatctccctgcttacaacaaggtggcctttcttctagtttcctgtcatctgatggaagagattctagactcattcctctagaggagaaatacttcatctagaacagataggtcctaagggtgagagctcatcgttgggatgaatgaacccactgaaattttatgcaagaagaaaattgtgtatatgtatatttttttttctggtctgtagtttttattagattctcagggaatcctgatcctatcatgaagaccttctattctagattgggttcctttcacatccccttctcctttcttgttgaattctccatgcatttctttcacttgcttttcttgctcttatttctctggtagtcagttatcctttttgtctggtggttctatctccttcaaatgaggcacattgctcaaattttattactccaaattccaaggtgctgtttagtgtcctgttgggttgtaagctaggaacagggaggggaaagtaaaacattctgcatgagctgggtgcagcgggcaagcacctggaattccagctactggaagctgaggtgggaggattccctgagcccaagggtttaaggccagcctgggcaacaaagtgagattttgtcttaaaaaaaaaaaaaatcccagctgggctctgtggctcatacctgtaatcccagcactttgggaggcagaggcgggcagatcgcttgaagtcaggagttccagaccagcctggccaacgtggtgaaaccccatctgtactaaaaatacaaaaaaaaaaaaaaaaaagcctggcatggtggtgtggtgtgcactggtaatcccagttatttgggaggctgaggcagcagaatcacttgaatccaggaggcagaggttgcagtgagctgagattgtgccactgcactccatcctggatgacagagtgagactctgtctcaaaaaaaaaaaaaaaaagaaagaaaaaacacgcgcgcacacacacacacatcatgcagacctagccttctgccaatgtcaatggtagagaaacacagtagacacttaattctatgtttcagagaggaggggactcaaatatattaatttgacattgagacagtgatgactttaatgagtactttctttcctttttttttttttttttttcgggacagagtgcagtggtgggattttggctcactgtagcctccacctcctgggttccagcagttctcctgcctcagcctcctgagtagctgggactacaggcatgcactgctgtgcctggctaatttttgtatttttagtagagacggggtttcacactatcagccagactggtctcgaactccggacctcaggtgatctgcccacctcggcctcccaaagtgctgggattacaggcatgagccaccgtgcccggcctaatgagtactttctgattaacctgttgccctctcagattcctgaagcaaaccacagcgttaaaacgtgattcattttgtgtggaccaccacggtgtttaccttcttcttgggtgaagtttggtggaaaagatcttaccccggacatctgtttgttctttgtaactcagagcctcagagaaatcctaactttataatgttgtcaaacccttgtaaggcatgtttttattgtatttgtgttctgatcatgaaactgaaaatgtgtaagaggaagatttcagaagcttggctgtatgtctgagatgacagttcttttactgtcattctcaaatatatataaatattgaagagatcaaataacacaaatcgtgcatgttaagaaaagagactgtgaacctcaccagagaggggtgagcacaattttttttcttttttattcacagggttagcactgtccctttcacataataaatgctcagtaaaataaatggttgttaagccggaaaagggtaacacttctgataatgagtgtcctgggaaatttactaagctgtttagaagatgggaccaacacactgatagaaatagtcagatagtccagaagtctatggcagatgccctgaacatcagatgagatataagacagagaagctctgggtctttgccagctctgacattttatgactctatgaaacggaaggttcctttttagaagggtctataaactgtctcaggctttgggccattttgttgaagatcagaggcaaggaaaagacacaactacacaggaaccatcagggaaagatgttgttttttggtcttgaagcatcattgaatttttttttttttttttgagacggagtttttctcttgttgcccaggctagagtgcaatggcatgatctcggctcactgcaacctccgcctcccaggttcaagtgattctcctgcctcagccttctgagtagctgggattacaggcatgtaccaccaagcccgggtaatttttttgtatgtttagtagagacgaggtttctccatgttggtcaggctagtctccaagtcctgccctcaggtggtccgcccacctctgtctcccaaagtgctgagattacaagcgtgagccaccgcaccgggccgcatcattggattttaaggctccatggattctggcaggtccagcccttctgttttactcacaaacaagtggtttgtccaaagtcacacagagatggtggcaagagatctagaataagaaggtgtcttcaagtcatggagccaggaaccctggctttttgggcaatggaagtggtataaatgtttaatatcacccctcaggttctgccactagagcccagctctctcttccttcctcttgccccctgactagcctatggcctctttccagagaataagaaagggatcctcagagaataatcccagttcctcgctttttattatatagttgaggaaaccaagtctcagaggggtcagtgtcttgaccatacacctctcatgtcctctctcctttttgattaattgaataaatacatgtagttgcttcttacctcctttctttcttcacccctgccccatgcacctgctcttagttgccttcacatgtaaacagcattccaacaacaacaacaaaacacaaccagcattctaactcatgagaccagcaacagttcctataaataccagcagcattttattttaatgtctctctgcagtagtttctcccctccatggatcagtcatccttggtaccaaaaggattccccactgtgacacaaatgctttttgtcattctcagtgagttataccattgagagagcatcgatctttttattgttcaaagcttttggttgtcatgatatttgctggaccatgtttcaccaggaaccacatcacttcctagcagcaggagctattttcttccatcttctaacaacaccagcagtgacagtgataataatgatgttagctgccatggtcgttattcttatcatttattgagtacttactatgtgccagggactacattaagagttttatgtgtattatcacattgagcctcgctagcctttgtacagatgaatctgaggctcagagaggttaagctgctcacaagggagtcacacagctggtaaggggtggatcaggatctcagcctctctgctaggacacttctctaaacctagaataatactgggcctgtgttaagttcagcaaagagctgtattcaacccagtgtccttaggaatgtaatgcctgttattaacaacagtggcaacattgataagctgaaacttatgaggtgcttacaatatgatatactatatattatatacatacataggcacccacctataatctcagcactttaggaggccaagtcaggaggatcacttgagcccaggagttcgagaccagcctgagcagcatagcaagatcctgtctctgtaaaaagtttattttttcagttggccaggtatgttggtacatgcctatagtcccagctaatgaggaggctgaggcaggaggattgcttgagcccaggaatttgaggctgcagtgaactatgatcacaccactgcactccagcctgggtgacagagcaagactgtctctaaaaataaaaataaaaataaaattatttcaactctcaaggttaaataaatactattattattcccatttacagatggagcaactgaggctcaaagacattaaatgcttactgtcttagtctgttttctgttgcttatagcagaacacctgaaactgagtaatttataaagaaaaagcaatttatttcttacagttatggagactggaaagtttaagatcaaggctgcatgagctataatgcacacacactattgcactccaggctgggtgacagggtgagaccccgtgtcaataaataataatataaaataaataaaacaaatttcaacatgagttttggaaggtttgaaatattcaagccagagcatctgtctcataagtggtggacccaggatttgaactaaggcagatctggatctagaacccattttcttgaatcctacgctatttctctaaggtcaagtttgccaaggaaaataaacttgagaatttgaatagagctctctgacatgggaagtcagggtgatccttccttcccctccctgatcttgggttccactatggctgggggaaaacaggagcagaagagatttcaagaaatgagagattggcctagcgccatggttaagacctggacttcagagtcagaggaagctcctccctctatgacagtgagaatgtgggttgaactcactgaacctcagttttctcacctggaaaaagggagtaaaactagtgcctagctcctagggtttgcatcacacacgaaagttggtgaactgaaggaaaaaaacttaaattcttgtgggggagcatgtgatagatgctacaaattctccatgccttatttacctagcttacgtctaagttcacctgcagcttcctcttggtacactcccatctctctacatctctgttggagggcagtctctggcatcacagagtttgctgagccagatgcttaacaacctcggtagcatccctcaaccagtgagctagggagtcagtgtataaataccctggcttccccattgctcagtgggaaaacactgaaatatgttatacagcatcatagaggtgcctcagtaaaattgaatcctagttgttcacataaaacccattcactagtgtaccctttaccaatctctctcttcctcattcctcacttgtaattccttgcattacctcccaaattaaccattggaccctagtttttgccttggggtctactcggcgctaactcaaggagcggaagttggaagcttagcgggttacaggtttcagcaccctggacagctcccagcacaccgtattgtgctaaaatgttctcttccctccctctgcctccagctggggtggagagggactgagtaaaggccagatggccaggtgaccttgttccatactgagcttcttggccattttccctgtggggctggagaagaccttgccatccatctctccgcaggtttgggggccgactgaggtcttgttttctcgaattgctatgacaaatgccagcctgcctccaaggggcatctgtcccactgcctctacagtttgcatgcctaatgactcctctcctctcaccagggcagggaggtggctgcctggtgggccgcttgaagccgggagaccaagatcatgccactggactcgcaacaaaccgagactcttttttttttttttttttcctcgagacagggtcttgctctgttgcccaggctggagtgcagtggcgcgatcttggctcactgcagcctccgcctcccaggttcaagcactcccacctcagcctcccaagtagctgggattacaggcgcacaccaccatgcctggctaatttttgcatttttagtagagagggggtttcaccatgttggccaggctgatctcgaacttctcccctcaggtgatccactcgccttggcctctcaaagtgctgggattgcagctgtgagccaccatgcctggccaacagaataggactctgtctcaaaaaataattttttttaaacattgctttgcaacccagctgcttcttgtgcaggcatctctaaatgaggacagccagtctacatagacacgtaaggaagcatagtggttaagacctggtctttggggttagagtggattcccaacctgactccactgtttccaagctgtgtgaccttgggcaagttactgtacctccctgaatcttccatttcttcatctggaaaatgagagtagtagcatcccctgacttggtggggcatggtggctgatgcttgtaatccaaacactttgggaagccaaggtgggtgaatcgcttaaacttgggagttcaaggccattctgggcaacatggtgaaactccatctctacaaaaacaaaacaaagcaaaaattatctgggtgtgatagtgtgtgcctgtaattccagctactcaggaggctgaggtgggagaatcacttgagcccaggaggtcaagtctgcagtgagccgtgcttgcaccactgcagtccaacagagcgagaccttgtctcaaacaaacaaaacaaaacacaaaacaacaacaaaatactaccaccttatggagttgttttcaaggttcaatgagttaatgtctgacccatgctgggctgggtttatggatgttacttgcccagggacagtctgaagaaagagaaagtgatatagtccattgggcctcagcttcctcatctgtggaatgggaataataattgcacctacctcaaaaggtaaaagtcagtgagatacatataaggcattcagaacaaaaactggcacagaataagtgctcaattatattagctattgtaagactaataactatcattataatgatgataataattattactacttccccaggcccagttccatagaccagttagttaactgtagggaacgtttgctattattagttgggttcccaatatctgacctccctttccaatttagggagaatcctcccctttctataaagtactgctggtctatgggatcccaccctcactaataagttgaaggtgaaagggattcattgtcaccccatcacctggtagtcagggcatgtgatttaaacaaccagggccaggcgcagtggctcacgcctgtaatcccagcactttgggacgccaaggcaggaggatagcttgagccaagcccaggagtttgagaccagactgggcaacatagtgagacccctatctcttaaaaattttttaattagctgggggtggtagcacaggcttgtagtccccgctactcaggaggctgaggcaggaggattgcttgagcccaggaggtcaaggctgcagtgagccgtgatagtgccactacactccagcccagcctgggcaacagggcaagatcctgtctcaaaaaacaaactaataaaaaactcaaccagtcacgttttcctacccaggaatttgaaaatggaccaagtgatccaaacatgatggtttggactctttcatggcctcctgctacaggagaaggtcaggctggctacattgttcctgctgatttcccaaatcccctcttctggccccctgttgattatctgagtttcctaaaaatcccttttatgcctaagatagccggtcagtgtttggttttgcaatcaagaacccagactgggccaggcacggtggcccacgcctgtaatcccagcactttgggaggccgaggcgggcagatcatgagatcaggagatcgagaccatcctggctaacgtggtgaaaccccgtctctactaaaaatacaaaacaaaaaaaaaaaaattagccaggcatgatggcggtcacctgtagtcccagctactggggaggctgaggcaggagaatggcgtgaacccgggaggcggagcttgcagtgagctgagatggcaccactgcactccagcctgggcgacagaacgagactccgtcaaaaaaaaaaaaagaaaaaagaagaacccagaacccagactgatcctgagacaaagatttgagggcaacgaatcacgaggtcaggaaatcgagaccatcctggctaacatggtgaaaccccgtctttattaaaaatacaacaaattagctgagcgtggtggtgggcgcctgtagtcccagctactcgggaggctgaggaaggagaatggcgtgaacctgggaggcggagcttgcaataagccaagatcgcaccactgcactccagcctgggtgacagagcaagactccatctcaaaaaaaaaaaaaaaaaatttgaggacaagtggtttgtttggcaataccaggaaacaggggaacaggatagtcagaaaagaaagagaaagctgggcatggtggctcactcctgtaatctcagcactttgggaggccaaggcaggtggatcacctgaggtcaggagtttgagaccagcctggccaacatggtgaaatcccgtctctgctaaaaatataaaaattagtcgggtgtggtggcgtgcacctataatcaaaataaaataaaatcaggatattttattttaaaactctgtcttagtgtaactcatatttacctcttctgtatgctcctttgcatcagttatatattgccataatacggctgtgtaacaaacaatccccaagacccagtggcttataatgacaagcatttatttagctcatgattctgaagggtggcagtttaggctgggcccagttgggtgctttatctggtctcagttgagctcattcatgcatctttggtcagctgcgggtcagctgggtggctcttctgtttggctgttagctggctgcagactggtccaggatgacctcggctggaatgactgtgctccactccctatggtctttcaccctccagcaggctagcctgagctagttcacatggcagcttttcatcctccagcaggctagcctgagctagttcacgtggcagcaatgggattctaagagaaagaggaagtgttcagccttcttaagggctagtcccaggaatggcacaacatcgtgttggccactgttgtccaaagcaagcaatgaagctggtccagattcaaggaatggggcaacagagcccatctggtatttacctggggccactggggccccattcctgttccctggggccttttgccctgacttctgtgggccctcagagcatattttcagattcctttccatccctgaccctcagcaatcaatgtagatgacgtgtcattactgtgtcacttgcacagagaaaaggaggaaaaaatgtcagcaaaaactctgctgagagcagagggcccatcatacagcaagctggaaagaaaagtgggaatgattacacagcctcctcagatgcttccagcttttatcaaatctcactgtgatatctgagttctgaaccctcacaggtggttggcgtgcaagggaagagatttcttgtctgccatgctgacatgcacagacacgcaacctggctccctctgtccactggggctttggattttgtttgttgaaatgttacccactcctgatcagagctggatggaaacctggctctgattccattggctcaggggctcaggtgggggcagaggccaggctggttgggtgtctatgtggagaccttaactcttctccctcccgccccaactctttttgtttctttttttttttttttttttttttgagatggggtttcactcttgttgcccaggctggagtgcagtggcgtgatcttggctcactgcaacttctgcctcctgggttcaagcaattctcccacctcagcctcctgagtagctgggattacaggagcacgccaccatacctggctaatttttgtatttttagtagagacagggtttcgccatgttggccaggctggtcttgaactcctgacctcaggtgatccaccctcctcagcctcccaaaatgctgggattagaggcgtgagccaccacacctggcccttttcttttcttagctgcctccacctctcttcccttctgcagtgttaggtttatggaaaccgaggccggcgtagagatcaacttcagagagcatgaactgagcatctgctgggtcttagatcctttacatagcttatcatcttcaaaccttctcacagttctgtgtggctagagccaggatttggacacagctctgccccactgtagaaccaggcttccttctgtccactgtcaaattttagagggagaaaatagggaaagggacaccagccttctccacgagcagcttctgcccactcaccccagggactttgcacatgctgtgtgcctgtgtctgagatatgctccctcctctgtatctgcttaattcttacccagacatgatacataaagtatttaacatccaggtggcagggacaccagctaacctgaaaagaggttcccctgttgtgccacatgtgtactcattgtttgctgcattgtgggggcagtccaggggccttgaagaggggccaaggtgccaaaggggcactctcaggcctcaaggaagtacatgtttactgatatgatactgtctcttcctccaggaaggaagccttccctgatctccccactgcatgcccactatgataccagtttaggtcccctctttatggccatctgtggcatcagtgtgaatcctcttaatgttgtctatttggttaatcatctgtctccttcctctggggggtaaagacagaaccacagagcctcgtgtagaacttgagaatggggttcagtaaaaatctgttgaatgcataaatgggtgattgagtgaatgaatgaatgagtgaatgaatgagtgagtggatgaatgaatgagtgaatgaatgagtgagtgaatgaatgaatgagtgaattaatgaatgaattcatagctgataatacaggcttcatggcttttgttaggcttgcccagacattgctaggggatggacagaaggaagaagagctatacttaattccagtcctgttgttctgtagcaggaggagaaaaacagggactgcccagcctgctctgggtggattcaggagcagctgaggttcctctcttatttgcaaacagggaattcaaaaagccccaacctcagaatcacactcgcctcagcagctgtaccagccaaggggacaatgtgggaagccttgggcaccaggaatgctgagtgcttcgaaaaagcgaaggctcagggaacaatccctgatttttcattcccttgtcctttctgaagaaacaggcaaaggcaggccaggcacggtggctcacacctgtaatcccaacactttaggaggccgaggctggtgaatcacttgaggtcaggagttcaagaccagcgtagccaacatcatgaaatcccatctctactaaaaatacaaaaattagctgggtttggtggtgcatccctgtaatctcagctactcgggaggctgaggcatgagaatcacctgaactggggaggtggaggttgcagtgagctgagtctgcgccactgcactccagcctggatgacagagtgagactccatcttaaaacaaaacaaaacaaaaacaagtaaagccttgtgtgtttttaaattgtaggttcagcagcaaagctctgtaataaggagctggaccctgcagtcagacagtcatgggcttctccagtgcccagccgagtgacccgagggagttatgataaacaccaacattcatccacaatttgtacctagtgctattctcaatatcttgagtaaattatctcatttaatcctccaggcacatctttcttggtaggtgccgtcattgtccccagtgtacatctgggaaaatgaggacaggctggcagagcacccttcctgctcacctctgctgctctgctgacctctggcaagactgttgtctctctgagcctcagtttccccatctgaaaattggggcctgtattagcccgttctcacattgctataacgagatgcttggctggggctgggcgtgatggcttatgcttgtaatcccagcactttgggaggctgagttgggcagattgggagtgtgagaccagcttgggcaatatagcaagaccccatctcttctaaaaaaaaaaaaaaattagccaggcatggtgatatgcacctgtaattccagctacccaggaggctgaggcaggagaattgcttgaacccaggaggcagaggttgcagtgagccaagattgcgccactgcactccagcctgggagacagagtgagactccatctcaaaaaacaaattatttttaaaaaattaaaaaaaaaaatgcctggctgggcacagtggctcacacccataatcccagtactttgggaggccaaggtgggaagattgcttgagcccaggagttccagaccagcctgggcaacacagtgaaatcctgtctctactaaaagtacaaaaattagccaggtgtggtggcacgcgcctgtggtcccagctactcaggagggtgaggtgggaggattgcttaagcctgggaggtcaaggctgcagtgagcaatgattatgccactgcactccagcctgggcgacagagtgagaccttgtaaaaataataataataataataaataaataaaaaccctgagactggggtaatttataaagaaaagaggtttaattgactcacgattctgcaggctctacagaaagcatggcagcatctgctcagcttctgggaaggcctcaggaaacttacaatcatggcagaaggtaaagctggagcaggtgtcctcacatggccagaacaggaggaagagagagagtggggagatgctacacacctttaaatgtccaatctcacaagaactcactcacgatctcgagaatagcaccaaggcggaaatctgcccccatgatccaattaccttccaccaggccccacctccaacattggggattacaattcgccataagatttggttgcggacagacacagatccaaagtacattaaaagtaatggcaaaaaccacaattacttttgcaccaacctaatatctcaggggctcattgtacctatttcacaggacaaatgaaggtatcagtaataacagtagcctgtagtcccagctattcaggaggccgagacaggaggatcacttgaacccaggaggtcgaggctgcagtgagctatgatcacgccactgcactgcaccctgggtgacagggcgaaaacttatctctaaaaataataataacaacaacaatagtgaacacagatataacatgtgtgtggccaggctgtgcccttagggctttgcagggattatttcattcactctcaatctccccattttacagatgagaaaactgacgttcagaaaagctagaggacttgccccaagccacacggctaggaagtggtggaattggggtttaaatgaggaagcttgacttcagtgtcgaagctcttaactgccacactcaatacatggagtagaggttgctgattctgtgattatctgattctggaaagtaaagaccctgtttccagacgtttgctgcttgacttagttcccaggggatggccactggatgatgcagtgttgcccaggagaggttagctagacacactgcaaccattccattgctaatacttatacttgctcttgttctgctgggtgctatgcagggaagggctgtctgagccctttgcaagaattctcccattggtgcctcccagagattctgaggttggggctttttgcatcccttattagcagatgagacaccaaagcccaggtcaataatctgacctgcatcccccgcctaccagccagaccaaggtcacttccccacaatgcaggccctgatccaaggctctgggtgcaaaccagtttccatgtccctgggggtccatcttcttcagctgactttttttttttttttttttttttgagacagcgtcttgctttgttgccgaggctggagtgcagtggtgtgatcatggcttattgcagccttgacctcccaggctcaagcaatcctcccacgtcagcctcctgagtagctaggactatgggcacacgccatgatgcctgggtaatttttttttttttttttttgagacagagtctcgcactgtagcccaggctggagtgcagtggcgcaatctcggctcactgcaagccccatctcccaggttcatgccattctcctgcctcagcctctcgagtagctgggattacaggtgcctgctacctcgcctggctaattttttgtatttttagtagagacggggtttcaccgtgttagccaggatggtctccatctcctgacttcgtgatccgcccacctcagcctcccaaagcgctgggattacaggcatgagccagatgcctggctaatttttaagtttttttataaaggcggggtcttgctatgttgcccaagctggtctcaaactcctggcctcaaaaagtcttcctgcctcagcctcccaaagtgctaggattacagacatgagccactgcacccagcctgactttttttctaactgaaaaattaattatatatattcatggagtacaatgggatgttctgatatatgtttacatttttgaatgattaaatcaagccaattaacatatccactacatcgcatacttattttttgtggtgagaacgcttaaaatctactcttttagcaattttgaaatatacaataccttatgttgtatattacattatgttgtatagtacgttgaaacatacactacaatacgttatcattaattgtggtcaccatgctgtgcaaaagatctctaaaacgtattcctcctgtctgactgaaactttgtatcctttgcctaatatctccccaatccctccaccaccagcccctggtaaccaccattctctctgcttccatgggttcaaattttttattttttgaaatttttaatttttatttatttatttatttatttatttatttatttttgagatggagtctcgctctgtcacccagtctggagtgcaatggtgccatcttggctcactgcaacctccgcctcctgggttcaagcgattctccagcctcagcctcccgagtagctggggttacaggtgcttgccaccaggcccggctaatttttgtatttttagtagagacggggtttcaccatgttggctaggctggtctggaactcctgacctccagtgatccacccacctcggcctcccaaagtgctgagattacaagcgttgagccactgcacctggcctaaaatttttttttttttttttttttttgagacggagtctcactctcttgctaggctggagtgcagtggcatgatctcagcccactgcaacctcagcctcccgggttcaagcgattctcctgcctcagcctcctgagtagctgggactagaggtgtgcaccaccacgcccagctaatttttgtatttttagtagggacagggtttcaccatgttggccaggatggtgtcaatctcttgatctcgtgatctgcctgcctcgggcttccaaagtgatgggattatgggccaccacgcccggcctcaaattttttagagctcacatataagcgagattgtgtactatttgcgtttctgtgtctggcttgtttcatcttagtataatgtcctccaggttcatgcacgttgtcgcaaaagatggaatttgctcctttttaaagactgaatagtacttcattgtgtacatatacacgccatattttcttcatccattcctttactgatggacatttgggttgtacctgcatcttggctattgtgaagagtgctgtcatgaacatgggtgtgcagctgactctgaggtgttagagggattacagctcctccaaaagaccaccgtcacccaaacctgctcctcctgccctattttctgtttaggtaaaggcggctttaaccccctgcagtgctctggcctcagacctccagatcttcctctatgcctctatgcctctttttctccaccccctgcatccaatctgttagcacatcttattggctctaccttcagaatctacccagaatccaccacccacctctcaccaccttcacagccccaccccggtccagcccccatctttgctggcctggactaaaccagttgcccctccaccccaatctggtctcttaacttcagtccttgccccacccccaggactgttccccacacagcagccagagggcacctgtgagccactgagtcaggacctggctcctctttgctcacaacctcacttggagaaaaagcccaaattctcctcacagggacccacaaactctgcccctgtgatcccccatccccctctattcccactctcctctccactcactcggcttcagctacacaagttccctgctgtcccttacacaccaagcactccccagcctcagggcctttgcacaggctgttccctctgcctggaacactcttcccccagatatctgcttggctcccccctcacttcctttgggtctttgctcaagtgtccttctaacatgtaactgcctcacctgcactgtgccaccccactccccgcctctaggcttaatttccctctacacccctgaagagcatctgccaagctatatttacttgtttattggttattgccaatcccctgcccccactagaatgccagctccatgagggcagggacttctgtctgttttgttcactgctattcccccagagcctagaacacagcctggcacatagtaagtattcactaaataatttgtaatatgaattgtgccagtaaaatcttccaggggcatcaagcccctgccatgactaggtggtaacatcctcaccccctgtccatgtgctatctcctcctgacctgcttgtctcattgttctaatggtggctcacgcctgtaatcccagcacttggggaggccgaggcgggcagatacctgagttcaggagtttgagaccagcctggccaacatgatgaaaccctgtctctactaaaaatacaaaaattagctgggcgtggcattgcacgcctgtagtcctagctactcgagaggctgaggcaggagaatcgcttgaacccgggaggtggaggttgcagtgagctgagatcatgccattgcaatccagcctgggccacaagagcgaaactctgtctcaaaaaatatatatatatatttcattgtggtaacatatgcataacataaaatgtaccattttttaagtgtttagttgagcggcgttaagtacattcatattgttgtgcaaccaggaccgccatccatctccagaacttttgcatcttgcaaaactgaagctctgcccccaggaaactctcactccccgctcccccttcccctctccccgactcccccttcccccctccccactccccccaccctactccacactccccactcccccagcccctggcacccgccgttctagtttctatctctgtgaatttggctactttgggtcccccctgtgagtagaatcatacagtatttgtctttttgtgactggtttgtttcgtggagcataatgtcctccagtctcatccatattgtagcatgagtcagaatttccttcttttccaggccgaatcgtattccattgtgtggatggaccacactttgcttatctgttcatccagatgggcacttggcttccaccttttggctattgtaaataatgctgctgtaaacctgtgtgtacaaatagctgagtccctgctttcaattcttttggatatagacccagaagtggaattttttttaaatcaagatttgacccactggggcccttagaggtctcattggctctgaagcttttttttttttttttttttggacgctttgaaactaaaaataggagtgaggggcacagtgaggggggcacacatctctcgtgtcagcgttttttaaaaacaccccgggaggaagatgtgtgaaatccctcccttccccccgctcccaccccctccaagatctcaaaatacctcttgttttaggaagcggctgtgacatcaggcaggcagcgtgtggcatctgagacacaatatcgcaagtggctgggagcccagagaaaccaggacaggcgtgctggggatgtggactagagatggagctaattttagtggctgaagaggctgcaagaagagagagaaagaggggtgtgtgtgtgtgtgtgtgtgtgtgtgtgtgtgtgtgtgtacgcacagtgatagaggctggagggggagaaatgacagataaatcagcttgggcaaagaaagctaatgggcagaggagcgagacccagctcagaaggtggtcagcaaatctaaagatgtgtgcccgagggtcaaggtggtggggggattcataggcaagtggtagagaggctattccatttgcagaggctctctctgtttgaggcgtgattcacctgtgccgtcctcaaggccattctgagaacaccactgttgttttcctccttttatgagtagggaaactgaggcattgaactgcttctattcttcagtaagaagcagggggaacatatggtagaagcaaagaaatacaaacatgagggctctcggggtctacgtgattggctgtgacatccatgagagcggatcgcaggttgaaggaaacactggtggcagaaagtagctgaacatttggatttgggaatcccagtggacgtggcgaaaattctggcttttcccttcacaggctgcggggccactctgacctgcggtttccttatctgtgaaatggaacgatgccacctgtctcagcgttgttttgaggatgcgaggagatgatccgtgtaatatgcccactagggggcctgctccagggtagattctcagcaaatggtagtcatggtttttgttacatttggggatattggcaggtaaaaaggaaatacttcattcattccaaaattgctcactgaggttctactatgtgctaggccctgatgacacatcggtcaacaagacaggcctgctttctgcccttgtaaaacttcagttcaactgcattgcactcatcagcctaataatccaggtaaattgtgatgagaataacaactagcatttactatgagccctttacaaatattaacccatttaatcttctaaagagcctataagataagagctcttgccctgcgcagtggctcacgcctataatcccagcacgtcgtgaggccaaggcaggtggatcacctgaggtcaggagttcaagaatagcctgaccaacagggtgaaaccctgtctctgctaataatacaaaaattagccaggcatggtggcaggtgcctgtaatcccagctacttggctgaggtaggagaatcgcttgaacccaggaggcggaggttgcagtgagtcgagatcactccactgcactccaagagtgaaactctgtcacacacacaaaaaaaaacaacctgttattatccacattttacctatgaggaaaccgatgcccagagaggttaagtaactgtccaaaggtcacacagctacggagtggtagagctgggattcagacccaggagtgtgatcccagagtgtgtgtgtatgtttgtttgtttgtttgtttgtttgtttgtttttaccactgtgttttcctgcttctgcaatagaagtaatcaccagtaacactgagcagttgttatgtgccatgcccttaacacacatctccttggatctttggaaagaatcctaaaagggttgtttttcatgatccacattttatggagagagagagatcaaagcatagagagaggaagtaacttgcccaagatcctgcagctgaagactctagggttgcaaatttgggacggccctggaccctgcattccagcttctagcagctcatagggggaactctttatttatttatttatttatttatttatttatttatttattttgagatggagtttcgctcttcttgcccagcctggaatgcaatggcatgatctcggctcactgcaacctccgcctcctgggttcaagtgattctcctgcctcagcctcctgagtagctgagattacaggcatatgccaccacgcctggctaatttaattttttttagtagagacggggtttctccatgttggtcaggctggtctcgaactcctgacctcaggtgatccgcccatctcggccccccaaagtgctaggaatacaggcctgagccaccacgcatgccctgggggggaccacttttatcggtgcatttcttccattttccctgtgtctgtgtaaagataaacacccccaagccccttgactatgaactgtgggccataattagttaatggaaggtaaatgttttagagacggaaattgctgtgccatttttccccgctaggcattgttgcctgcatgctaatgcaacacaatgtgcctttcttctgtcaggcatttttagacaaattctattttccctaaaatattttgccaaagaaaatagcaaatggggaagacattcagaggctcaggcagagagaggacaccattcccttgggtttaaacagaatggcagagtggataacagcacagatcttgagttaggtggatgccaatttgtgatttatttcccagcaaaccaagatgctggctctctgtgtgcctcagtttacttatttgtcaaatgaggagaataatggtacctgtctctcaccagcttaccagttgcctctttagctatgtctaatctgctattaaccacgcccactatgtctttaattccaagtattagaattgttttcttcctacaagctgtctgatcttttttaatcctgcttcatcttttgcagtattgttttcctacagcaggatttctcaaccttggcacaattgacattttgggctaggtaattcttggccgtgagctaccaccctgtgctaagatacttagagcatccctggcctctcaccctactaaatgccagtagcagcccctccccagttgtggcagccaaaaatggctcagacattgccaaacgaaatgtcccatggagggtagaaacgcccccacttgagaattgttctataggtattttcaagcatgtcttacatttctttaagtataatatgcaaaagaaaaggctaaatctaaaaaaagcccataatatgcgaagaatttttataatcagtgtccaataacttaagtatctaaaattgttatggctttttttctgctgtctcttgtttcctgtgattcctcattctggtgccttgttttcttgaatgtcttgttatctttggttgtgtgaagctcattttccatgggacactattttttgttttgttttgttttgagacagagtctcgcttggttgcccaggctggagtgcagtggtgcaatatcagttcactacaacctcagcctcccaggcccaaatgattctcctgcctcagcctcctgagtagctgggattacaggcgtgtgccaccacacccagctaatttttttgtatttttagtagaggcagggtttcaccacgttggccaggctggttttgaactcctgacctcaagtgatcaacccgcctcggccccccaaagtgctgggattacaggtgtgagccaccgtgcccggcatccatgggacactgttgaagggagttcattgaggcctgcgatgaaggcgaaccctccatggacaatttgcatttactttttccaggtgtctgggaaactcccagtctaggaccatcttagacttttagaccaacaatgtgttgagaatttaggtcaccagtgtctgcaaaagccagcttgtggttataatttctcaaaaacttttgtttttctccttttctgcaaagtgccaaagtaacttcctcaaaaatctctgggaatggaaagacgggagtaaattaacttcaggtttcttacctgaaagtgatagcctattggggccccatcctacttggggagtggtgtgtctcctttgagactttctaacacgtgtgtaccctggactttgccccacccctgctccctaggaggccataaaacttgaagcagcagttccatgggttagacagatgcccttggggcaaaagtggttttaatgctctggtagatgctcaggttacctctgggaaattcttgacttcacttatttatttggggctgataactactaattgtcaggcctttcttgtttcaacaacatggacttcagattttatgcaggatttgtcatcgttttcagcaagagagtcagtcttattacccagcttactgcattagaaatagatgtctgggccaggcgcagtggctcacacctgtaatcccagctgtttgggaggctaaggtgggcggatcatgaggtcaggagttcgagaccagcctggccaacatggtaaaaccccatctatactaaagatagaaaaaattagctgggtgtggtggtgcgtgcctgtaatcccagctacttgggaggctgaggcaggagaattgcttgaacccgggaggcagaggttgcagtgagccaagatcgcaccactgcactccagcctgggtgacaggacgagactctgtctcaaaaaaagaaatagatgtctgttgtgtggattatttaaaagagtagatggccaagaactatgacttatgcctgtcatctcagcactttgagaggctaaggtggagggatcacttgaggccatgagttagagaccagcctgggaaacatagcaagacccccatctctgcaaaagtaaaataaaataagttagtgtgcatgatggtgcaggcatacctctagtcctagctactcaggaggctgaggcaggaggatcacttgagcctaggagtttgaggctacagtgatctatgatcatgccactgcactccagcctgggtgacagatcaagaccctgcctctaaaacataaaaataaatacaaattaagttaaaaaataaaataaataagtaatagaacatccagcacagttcttggcatgcattgactgttgttgtttgtttgtttgtttgtttgtgacggagtctcactcttgttgcccaggctggagtgcaatggcatgatcttggctcatcataacttccacctcccaggttcaggtgattctcctacttcagcctcctgagtagctgggattacaggcacgtgccaccactcctagctgttttgttttgtttgtttgtttgttttgtatttttagtagagatggggtttctccaagttggtcaggctggtctcaaactcctgacctcaggcgatctgccagcctcggcctcccaaagtgctgagattacagacgtaagccaccacgcctggccagctgttttgattgttaaatgaaggtggtatgaaagggaaggaagaacagtgacatttgcaagggacactccctggagggcagggcaagggggctgtggaggggagaagtcagagagtatgatacaggttgccttgggtgatgttttagattttagccaacattggcaaagagcctcatttatctctcagagtagctctggctactggaaatgctgcacaacttcaggcggactttctagaagaaaactcttggccaggtgcagtgactcacacctgtaatcccaacactttgggaggctgaggcaggtggatcacttgagctcaagagtttgagaccagactgggcaacgtggcaaaacctcatctctacaaaaaaaaatacaaaaattaaccaggcgtggtggtgcatgcctgtatcccagctacttgggaggctgaggtgggaggattgcttgagcctggggaggtggaggtggtagtgagccaagattgcaccactgcactcccatttgagtgacagagcaagaccttgtctcaaaaaagaaaaaaagaaaagaaaagaaaagaaaattctctctgggattcaatcctggcccacacagcattggcttcacttcacctccttctcccctgagatacacagcaccattcccccaagcttcatcaacttaatctctgatctgggtgctgtgacttgtccccattcctggccagaatttaaggtagggatgaacccactagccctccatcacgcactctgccataaaagcacaccacgtgctgattgctgtctttggtctcctttctgccttgccctctagactctgagctgcttggagacagaggccagttttgtccatctccaaatcccctaaagtcctgtggccagcaagcaggtaggacatctgaaagttcgtcagagagggaattgcttttctcttgagatgcaactagaacaagaatcttattgacctggagtagcttcaaggttgtaagagtatgtgtcagggttctccaagaccactctcaggtttgaaggtttgctaaaagggctcacgggacccagaaaagctgtgaaattcagttatggtttattacagtggaagaatacagataatacagattaaaatctgcaaagcaaaagatgcacaaggcaatgtccaggggagatcaggcatgagcttccagctgttcactcccagtggagttatgcaaacagtgctcaattctcccagcaatggtgtgtgacaatgtacagtgtaccgccaaccagagaagctcacctgagccttggtgtccagggtttttattggggctcagttacattgacatggagcacccatgtgactgactttaactgctgggtctccagcacactccaagatcaaactgataccgtgtgtcccagggccccagctgaacacaaacaggcagtcaccatagatcccattgtgagcataagctaccaggcatggcccaaagccctagatatacagatattctttccaggagccagccaagggccagtccttcctttggaatatgcagagtttgaactccccaaccccaaggagttaactctttactacacagaatataaatctcaccaagtctttcttcttgtcaagtcctctcaaggtgacccattgcttttagcagtgtctttgagaccctgcgtcatctggccttgacccatatcacctgtgttatctctccactctagctacattgaacttttcttttttgagatgtggtctcactccatcacccaggctgaagtgcagtggtacagtcacagctcactgcagcctcaaactcctgggctcaagtgatcctcccacctcagcctcctgagtagctgagcccacaggtgcatgccattacacccagctaatatttttatttttagtaaagatgggttctcactatgtttcccaggttggtctcaaactcctgggctcaagcagtcctcccatcttggcctcccaaagtattggcattacaggggttagccaccacatccagcccattgaactttttaaggatcccctagcatcctatactttctgtcactggatagccttggaattatttttccttctttttgaaatactcttcttctttccaccctttgctgtcaagtctcagaataggcattatttcctccaaaaaccctctcctgaccctccaaatctggatgaggacacttcctttgcccagagagcacctgttttaatcctctcaggtggctataataaaataccttaaactgggtggcttatacacctcagaaatttattttccacagttctggaggctgggaagatcaaggcactgacagatttggtgtctgatgaggggccatttcttgtttcgtagaaggggtcttcctactgcatctttccatggtgaaaagagttgaggcagctctctgaaacctctttcatgagagcatgaatccctctgtcttcatgatctaatcacctcccaaaggccccacttcctaatatcttcacattggtgactaggtttcaacatatgaatttgagaaagacacagacattcagaccatagcagtgctcttccaccaggttttttatccccctgtattataattgaggtttaaattatctgctttccttcccttagattgtaagctccatgagagcagggccctacccatccagtcattgtcctatcccccatgactacaacttcctgggtacataattaatatttattatattatgtagcaaaggtatgctgccatactaagagacccaaaaggccaccggattaaaaccttaaagaaaaaaaaataatttctctcctataatagctgcaaggttagccatgcaggttggcagggaagctcacttccacaaagtcactcagggattcaggctcctgttgccctcttcttttctaccaccaaatgatcttcagcaccatttgcacaatcaaaacttaactggtcttgaataggcagaccttgaatttctgaagtctcagacccaaaagtggcagctgtcacttccactgacatatcactgatggaaacttaatcatgtgatcataccaaactgctagggatgctgggaaatgtagttttgttgggaactccatgacttggctaaaattccattactgtagaagatggtgggggatgggggagtggtggacatccagtggttgctaccatatttattgaatcaaattgtcaaacaggacctatctgataaggggttcttttccagaattaactgaagtattaaatcaggggcaaaggcatgtcacctcatctttctctccctatattggctttctagggctgttataacagagtaacatgaacttggcggcttaaaacaacagaaatttattttctcttagttctggaggctagaagcctaaaatcaaggtgtcagcagagccaccttgacaactgctctaggaaagaattcttccttgcctcttctggtggctcctggcaacccttggtattctttgtctggcatccacttcaatctctgcctccatcttcatttgccttttttctctgtgtgtctatgtcctttcctcttcttagaaggataccagtcattgaatttagggcttactctaaatccaggatgatctcacctcaagatccttaattagttacatctgcaaagagcttatttcaaaacaagattgcattctgaggtttcggtaaacacgaatttgggggaaatagtattcaactcaattcactgctttacttaagaaaagagaccatgaagtgagcctccttctgcttgagagagagagcgagcctttctgtgcaataggtcaatgaatggatgcagctgaattccacataactttataaaaatagatggccagcccatggggtttgctgacccctgcccaaaaattccaaagtcaacagcagtctcttttttaatcatttctctattttttaatttatttttatttttatgttgagatagagtcccgctctgtcgcccaggctggagtgtagtagtctcggctcactgcaacctctaccttccagatacaagtgattctcctgcctcagtctcctgagtggctaggagtacaggtgtccgccaccatacccagctaatttttgtatttttaatagaaacagggtttcaccatgttggccaggctggtctcgaactcctgacctcaagtggtccacccacctcggcctcccaaagtgctgggattacaggcatgagccaccatgcccggccaggattttcttcattttaacagcattcttacttgtcccacatccattctatcctgggtctaattagataacaaaatctacagatcttgtttaactgacattgtcctgggggatactttttatcttttgagacaaggtctcactctgttacccaggctggagtgcagtggcctgataacagctcactgcagcctcgaccacctgggttcaagcgatcctcccacctcagcctccagagtagctggaaccacagatgcatgccaccacacctggctaatttttaaatttcttgtagaggtggggtctccctatgttaccaaaggctggtctcaaactcctgggctcaaaagagcctcccaccttaacctcccaaagtgctgggattacagatatgagccactgtttccagccttggaaatatagtctaagaactgagtcaataggcgattttgtcattgtgtggacatcatgtagagaacttaacacaaacctagatggtataaactactgcacacctcagttatggggcataccctattgcacctaggctgcaaacctgcacagcaggttactgtcttgaatactgtaggcagttgtaacacaatggtaagtatttgtgtatctaaacatatctaggccgggcacggtggctcacgcctgtaattccagatcacctgaggtcaggagttcgagcccagcctggccaacatggcgaaactccttctttactgaaaaatgcaaaaattagccaggtgtggtggcaggcacctgtaatcccagctattcgggaggctgaggcaggagaatcgcttgaacctgggaggtggaggttgcagtgagctgagatcatgccactgcactccagcctgggtgacagagcaaaactccatctcaaaaaaataaaaaataaaaaacatatctaaacagaaaaggtacagtaaaaatacagttataaccatatgggaccaccattgtataggcagtccgctgttgatcaaaacatatcaaaacatcgttatgtagcacatgactgtaccataaaccacacggcttcaaacaagggaaatgtattctctcactgttttggaggccataggtctgaaatcgaggtgtcaccagggtccctccaaaggatccgggggaggatccttccattggatttggagttgcttcactccagtctctgcctcagtggtgacagggcgttctcctcttccctctcaaagttccctcttctgctgtgtcataaggatacatatgactgcatttaggccccactcagaaaatccaggaataaactcttgccctcatattcttaactaaatcgtacctgcataccttattttttctaaataaggtagcattccagggattaggacatcaacataacttctggagggttcactgttcaacccactacagccagaatgcgctttgaattcaggttctgacatctgggactgcctcccacgtacacacaccactaccttgtactgaatgcctgaagggttctgcccccacctccactcccccaaatatttgctgtggacctgagaaagctgacttcatggaagcttcattccattgttctaaggacttttcatacattaacaaatgtcttctctctatggggaaaaccacagagaaatcaagacagagtggggttaagtaactcacctgaggaggaacagtaagtggcagagccaggattcaaaccaacatggttttgcacagttttgacatcatttgcaacacaaatattgtcacagatacctttttgagcatctactgtgctaaccgccaggaaggaaaagaacatggggccgggagagctcttgacaggggacagggctggccatggaggtctgtgtcttggtggaagatgctatggttctctttttttttttttttttttgagatggagtcttgctctgtcacccaggctggagtgcagtagtgcaatcttagctcacagcaacctccacctcccgggttcaagcgattctcctgcctcagcctcccaaatatctgggattataggcacacaccaccacgcccagctaatttttgtatttttagtagagatggggtttcaccatgtgggccaggctggtctcgatctcctgaccttgttgtgatccacccgcctcggtctcccaaagtgctgggattacaggcatgagccaccacactgggcaactatggttctcttttaactccttgtgctgaaattattgcagaagcccaggccagttcatccccagaaagtgaggcataaacaggcagagctctacagaaacagagaatccacgactggtttgatggaggctgcctcactacctacagaatgggctctgggtggattgttctatctggggagccagcccacccaccagtctcagcccttggcgactctttcctgctgtcacagcagctggacattcagaaaccgaaacatgacagccttccctccctgttcctgcccagtggagtggaaacccctcgggacccacataccgagcgtgcacagcagcacagagttgcacagttaacacagcgcttcttctccagccctccggatgcaagctgacagattggcagctggctgacttccaaggtccagtgagttcttggcagtcgctttctgacctggacgagtggctgccacctcctggaacatcaggctgcccccttggggagagggtgacggtctctctggaaagactgtgagctttgaggtggtcatcaaaagccattcttggaaacattctttgagctgtaccgtgcaattcggtcaccaattgcacgtatttggatattaatatccgtatgtggatattaaattggttttgggttttgttttgttttgattgtggcaaaatatacacaacaatcctcctgcctcagcctcccaagtagctacaggcatgcaccaccatacccagctaatttttggattttttaaatttgtttgtttgtttttgttttttgagatggagtgtagcactgttgcctgggctggagtgcagtggcgcgatctcagctcactgccacctccgcctcctggattcaagtgattctcttgcctcagcctcctgagtagctgggattacaggcgcccgccaacacgcccagctaattttttgtatttttagtagagatgaggttttaccatgtcggccaggcttgtctcgaactcctgaccttgtgatccacccgcctcagcctcccaaagtgctgggattacaggtgtgagccaccgcgcccggccgatttttgtagttttagtagagacagggtttcaccatgttggctaggctggtcccgaattcctgatctcaggtgatccaccgcctcggcctcccgaagtgctaggattacaggcatgagccaccgcacacagcctaaatgctgtgcctcacgcctgtaatcccaacactttggtaagctgaggccagaggattgcttgagcccaggagtttgagaccagcctgggcaacataggaagaccccatctctataaaaaataaaaataaattagccaggcgtggtggtgcaggcctgtggtcccagctactcgggaggatgaggcaggaggatcgcttgagcccaagaggtcaaggctgcagtgagctgtgattgtgccactgcactccagcatgggtgaaagagcaagaccttgtctcaaaaaaaattaagcgaaatttaaaattctgtttctcactcacacaggctgcacttcaagtgcttaatcatcccttgtgggtggtggctatcatattggacagcatggatagagaatatttttatcagcgtaggaagcttcatcagagaggaccgctcagaggcctgtggggaccagcacagtgcagtagaagacacaggccagctggtgagagactggtcttctgatcccagatctgtccctcacttgctaggtgaccttggacagctccctcagtccctctggagttttctcttcattgttaaatcaggaaattggcctcagtgaattctgaggccccatctacttttttttttttttttttttttttttttttaattgagacagagtctcgctctgttgaccaggctggagtgcagtggcatgatcttggctcactgtaacctccgcctcccaggttcaagcaattctctgcctcatcctccccagtagctgggactacaggcgtgcaccaccatgcctgggtaatttttgtgttttcagtagagaccgggttttgccatgttggccaggctggtctcaaactcccaaccttgagtgatcctcccgcctcggcctcccaaagtgctgggattacaggtgtgagccaccacgcctggcctcatctagttctaaatgttatgacccactcagctctgaagacaagggaggaacatcctctcagtctagctctgacatgcagaagcctctcaccctgtcccccaggtcataaaggcaggcgtgttgtgaagagcacagaatgggctgagaaaaatatgcagggattgcgtctatctcccttccttccgcacgtttccttgtcggcaccacctgcctctattccgcgccgcacacacacccgccttctctctgtctcggaggaagacaggatcttccatcccccaaatcctgccctgattcctactctgaagcctctgccctgactcctttaagctccctgggaatacagcccatctcctatgccctcctcatcccagtagttcctaccttccccaaaatcgctttgggaaagtcccccaatgagtaaccagctgtcctacatgggcatctcagaacttctcttctgttgttgttgttgtttgttttgcttttgttttgagacaggatctctctttttcacccaggctcgagtgcagaggtgtgatctcagctcactgtagccttgacctcccaggctcaggcgatcctcccccctcagcctctggaatagctgggactacaggcacacgccaccacacccgggcaaattttttttaggacttttggtagaaatggagtttcgccgtgttgcccaggctggtctctaactcctgggctcaagcgatccgcccactttggtctctcaaagtgctgggactacagacatgagccaccacacccggcagagcttctatttcttgagtgtgttctcagccatgctaagacattttctcttctcagcctgatgatgcttttggcttgtgtttctttgtttttaattaccccttcccagtcgctgtcatgggatcatgagggtcttctgtccatctagatgacacctttcttgtgccacgtgtctccaacattccctggtttttaaacccttattgctttcaagatactatccaagctccttaatgtggcacattgtccttcgctgctatctgcctgctttttttttgagacagagcctcgctctattgcctaggctggagtgcagtggcgcaatcacagcttactctgcagcctcgacttcttgggctcaagcaatcctcctgcctcagccttctgagtagctgggaccacaggcatgcaccatcatgcttggctaatttatttttatttatttttatagagaaggagtctccctatgttgcccaggctggtctcaaactcccggactcaaagttcattgcagtttcaattttttccttggctcaaggatcctcccacttcagcctcctgagtagctgggactacagacgggcaccaacacacctggctaatttttgtattttttgtagagatggggtcccactatgttgcccaggcttctatctgcttttatctcaccttccactcttccatccttcctttcttttcttttatttcctttcccttcccttgccttccttttctttctttctttctttctttctttctttctttctttctttctttctttttctttctttctttcttgacagagtctggctctgtcacccagactgaagtgcaatggcaagatcttagctcactgcaacctccacctcctgggttcaagcaattctcctgtctcagcctcccgagtagctgagattacaggtacctggcaccacacccggcaattttttttttttttttagtagagacggggtttcgctatgttggccgggctggtcttgaactcctgacctcaggtgatcctcccacctcagcctcccaaagtgttgggattaacaggtgtgagccactgtgcctggccttttttttttttttttttttttttaagacaggaccttgctctgtcactcaggccagagtgcagtggcactataatcactttctgcagccgtgacctcctgggctcaagggatcctcttgccttggcctccctagtagctgggactacaggcatgtgccaccacactggctaatttttaaaactttttgtaggccgggcacggtggctcacacctgtaatcccagcactttgggaggccaaggcgggcggatcacgaggtcaggagattgagaccatcctggctaacacagtgaaaccccatctctactgaaaatacaaaaaattagccaggtatggtggcgggcgcctgtagtcccagctactcgggaggctgaggcaggagaatggtgtgaacctgggaggcggagcttgcagtgagctgagatcacgccactgcactccagcctgggcgacagagcgcgagacaccatctaaaaaaaaaacaaaaaaaaaaaacaaaaaactttttgtagagatggattcttgctaggttgcccaggctggtctcaagcttctaggctcaagcagtcctcttgcctgtgcctcccaaagccttgggattacaggcgtgagcccccacacctggtcctaacccactttctgaacttccaaccacaccattttgtcctaatatttaagtcacaccataacatgtcccacttcagaaatgcctaccaaagtagtcttcaaatctttttaaatcagtggaccctttctaccaaacaaatgttattttttaaatatttattttagagtaatttagacttttagaaaggttgtagctgggcgcagtggctaacgcctgtaatcccagcactttgggaggccgagacaggtagatcacctgaggttgggcgtttgagaccagcctgggcaacatggtgaaaccccgtctctactgaaaatacgaaattagtcaggtatggtggcacgcgcctgtagtctcagctactcgggaggctgaggcaggagaattgcttgaacccaggaggcggaggttgcagtgagctgagatcgcgccactgcactccagcctgggtgacagagtgagactccatctcaaaaaaaaaaaagaaaagaaaaaaaagaaaggttataaatatattataaagagttcccacatacccttcacccagtttctcctgttgtttgtatcttatattatcaccatatgcttgtcaatgctaaggaattgctgggtgcagagtggcacatggctgcagtcccagatactcaggaggccaaggcaggaggatatcgcttgagcccaggagttcaagtctagcctgggcaacacagtgagacctcttttctgcaaaagaaaacaaataaaacatctaaaaaagaatacactggaggcggcgtggaaacaaggatctcatttgggagttgtctgcaatgttctgagcaagcagtaacggaggcctcaagtcagggctgtggtcatggaggtggggaggggtggttggtttcactatctgtgttgacttaattttagatttgcagactcaactgagtatgaactttaagagaaagagagaggccaggcacggtgggtcacacctgtaatcccagcactttaggaggccaagtggggaaggccgcttgagcccaggagtttgacaccagcctgggcaacatagtgagacccctgtctctacaaaaaaaaatttttaaattagccaggcagggtgatgtgtccctgtaatcccagctactcaggacagtgaagcaggaggatcatttgagcccagaaagttgaggctgtagtgagctgtagttgcaccattgtgcttcagcctgggagacaaagtgagaccctgtctcaaaaaggagaatggggagagagagagagagagagaaggagaaagagagagaaagagagagagggaagtcaaggagaaccccacattttttgacatggtgtattagtctcttctcacactgctaataaagacatacctgagactgggtaatttataaaggaaagaggtttaatgcactcacagttccacatggctggggaggcctcacaaccatggcagaaggcaaaggagaagtaaaggcatgtcttacatggcagcaggcaagagagcttgtgccatttataaaaccatcagatctcatgagacttattcactaccacaagaacagtatgggggaaactgcccccatgattcagttatctccacctggcgccgcccttgacacgtggggattattacaattcaagttgagatttgggtgggaacacagccaaaccctatcacatgggcaagtgaaaggatgggtttgccatcaaataaaatggggaaggagactgactaggtgggcagattaggaactcagctttctatgaagtgcctactgatggatagagatattgtgttggccatctattaggttggtgcaaaagtaattgcggttttgccattaaaagtaatggcaaaggaaataacctttgcaccagcctaataggaattggagtctaaaattcaaaaaaggtaagtcagagctggagatccaaaggcaggagtcagcctcctgtggaggctatttaaggaactgaataagggcatagatgcaggagagcacccaggactgagcccagggcttactctccatcattaaagaggttggggaagatgaggaggagccagcagagaagactgaattggagcaaatcagaagaatgtgggtgctggctgtcatgcaaggaaagtgctaagccatttcaagtatgagggaatgatcaatgatgtccactgatgctgatgtgttgactcaaatgaaaaatgagaatcaaccattggatgtagtggcatggagatctttcgtgacctgagccagagctgcttaggtgaagaggtgaaggcaagaggctactggaaggattactactagctcttttaaagagttctgctgtgaagggtagaggaagagagatggggcatgtgttagctggtgggggaagtggatttcagaggtttgtttcccttaaaaaaaaaaaaaaaaagaaaaaagaataaagaaaaaaaaaaggccaggcacaatgactcacacctgtaatcccagcattttgggaggctgagacctcgggaatttgagactagcctggacaacatagtgagaccccatctctacaaaaaaaatttttttttaattagctgggcatggtggtgcatgcctgtggtcctagctacttgggaggctgaggtgagaggatctcttgagcctgggaggtcgaggctgcagtgagctatgatcacaccactgcactccaggctggacaacagagcaagaccctgtctcaaaaaaaaaagatgggagacctaacagcagattttatgctgataggaataacctattaggggagaaaaacatgaggatgctggaggaagaagagtgtcaggaggacatctcttggtggacgagaggggatggcatttggtgtacaggtggaaggtttcactttagatgacagcacacacagttatctatagaaacaggagaaaatgcactatatgggcatacatgctgggaggtagagagtaaataatagtggtggttgcttgtggaaattctcttctaatgtttttatatttttatggtttatcaaggacaatttatatttttacagtttactgcaaacaacaagttctaatttattcaataattatttgtgggtagaccgagtgcagtggtgcatgcctgtaatcctagcactttgggaagccaaggtgggaggattgcttgaactcctgattcacttctgagcttgaatcaggagttcgagatcagcctaagcaacatggcaaaacactgtctctacacaaaatacaaaaactagccaggtatagtggcatgcacgtagtcccagctattcgggaggctaaaacgggaggatcatttgagccctgaaggtggaggttgcagtgagccaagagcgagccactgcactccagcctgggtgatagaataagaccctgcctcaaaaagaaattcttattcttcttcttcttattattatttgaggagacatttactttgtaccaggcgctgtgctagatgctggagatacagacatcaacaatgacaaggctaagtgcctggcgtatttgtactttgagtctaataaaagacatcacacagacacacaacacacacacacacacacacaggattgtcaaaggatcaaccatttcacatgtcaagatcaggaatgatattggtctactactgccttaccatatctcctaccatgacctcatcttcctcttgccagattttaagtctttatacctcaactcccagaactctcttcgcctcacaccctatcacaatgtcatccgtaccccacggccaatactccatcattcgggaaagcaaagttccaaagcgtcaagattgtatcaatggacctgtctctatggcaacagtcctgaatgagccaagcaaggtaaccctggagatggcgtgaatgagaaagtggcctgttgccacggagacgtgctgaatgggaaggcccccacgagccaggctatgtcacgaagccgaaacagtcagcatgaagtcggtatgtctattttcaactcggaattacaaaaatacattttaatagagctcatgacccatctccttcctcgtccctgcctcccaccccactcttcagccttcatcctacaacacaatcgagcctcaccaggaacccttcaaacccctcaaggacaccttactgttccttcagtacacagtccccttcctgggctgaggtggtattcctttgaccaactactgtctcccctttgggaccaacagtattctcaaaagccatgagcttatgggaagaacattaactacattctttggggcaagaacagttgctcacctgtgaaccagctcagcttgcatctgtgagaatgattgcaatgggtagaccagttctccatcaaagaatggccctagcaccccacacacagtggtataatctgatcatgctggtgtattgaacatataatgttagtgccacatgaaaggaatttgtaaaaggacttagtgcctagaaaggtacctttgaagatcttggaatctctgaaacttacccaggttccttataccctgctcaaagtattcctccatttatttcttcattcattagttcttttgtttcaccacatatatatttttgaaacggggtctcactctgttgcccaggctagagtgcagtggcaagatcgtggctcactgcagcctcaacctccccatctcaagcagtcctcccacctcagcttcctgagtagctgggacaccacaggtacaagccaccacgccaggctaattcttgtaatttttgtagagacggggttttgccatgttgcccagtgtattcgtttgttctcacattgctataaagaactacctgagactgagtagtttataaagaaaagaggtttaattgactcacggctccacaggctgtgcggaaggcatggctgaggaggccacaggaaacttgcaatcatggcggaaaatgaaggggaaacaagcacatcttcacatggtggcaggagagagagagtgagggggggagtgctacaaaaccaggtctcacgagaactcactcactgtcatgagaaaagcaagggggaaatctgctcccaggatccaatcacctcctaccaggtccctcccccaacattggggattacaattcaacatgagatctgggtggggacacagagccaaaccatatcacccaggctggtctctaactcctgagctcaagcaatctgcctgccttggcctcccaaagtgctaggattacagacgtgaaccatatttattaagcattgttacagcaaagagaagcattgttgcagcataacaattggaagactccattgatggacgtctccatcaacaagaactgtcggataaactatggtacacccatcccttagcgtgttatgaagtcattacaaaaagaagaagcagatctctgagtgtcaataagagctagtacttatagggtgtctactgtatacaagtgctgttagaaagtgagtattaactcatttaattcttgtaacaagcctgtgaggtggattctttcatatccccattttacagagaaggaaataggaatctctatatccaagatatgttatcaggtgacaaaagcagtttttgaatggtgccgccattttctcgtaagagcaaatctggaagattccatgagaaattaataattgtgtttgcctctgtagcggcaccctgaaagatttggaagtaggtgtggaaaggaaacttactttcttgtgtctttctgaattttgtactgtctacgcgttttgtctttcacaaaaccaaacagaaaatgaccatttggtgcattttgtgtgtcaggcattcttctagtctagagaagcacaggagagcaaaatattttactgacgagaaaaatgaggcatggagaagttaagtgacttgcccaggtagcagagctgggattccacatcatagggtttatacaggaaacaggtaaacagagctgtgcttgtgtgtgggtatgtgtgtacacatgcatacatgtgtgcatgtgtgtgtgtgtttgtgtgtgtgtgaatgtgcttgtgtgttgggagagggaaatggcaagagaagaacctacagaaggtcagcaggaaccaacccatgttttgaggagtttggactttatcctgaaggcacaagggagccatggaaggatttagacaaggggtggttgtgcttagctttttatttagaaggatgactctggctgaagggtgatggcccagaatacaggtatatgtgaaggactcctcctgccctagtaggaggatgcccacccaccctctctgcccagtgcagtatcaaagggcaaattgggtacagagaattctcaccaagctgggtagaatccactctgatgctggggagtggacactgaatgcaccagcctctcctcctgctcaatccctgaattgaagctgttccactaatgttagggatcagattcccttcatatatatatatatatatatatatatatatatatatatatatatataattttttttttgagacagagtctccctctgtcacccaggctgaagcccattgtcgcgatcttggctcactgcaacctccacctcccaggttcaagcaactcttgttcctcagactcccaagtagctgcgattacaggcacccgccaccacacctggctaattctatatttttagtagagacagggattcacctatgttggccaggctggtcttgagctcctgggctcaagtgatcagtctgcctcagcctcccaaagtgctagtattacaggcatgagccaccatgcccgtcctttttatattacctttttttatagagatgtggtttcactatgttgaccaggcaggtcttaaactcctggcctcaagcgatcctccctcctcagcctcccaaaatgctaggattacaggtgtgagccactgcatctgtccagactctgttctccataaagctggcatatggaaagagggaagaccatccaggcaatatcgaagtcccattggtgctgatgtggctgctgagaccacatgaatggatgcattctgactctgccacctctcagctatgtgaccctgggccagtcagcaagtccctctataactcagttttctcatctgtaaaatggcgtcaacagtagccaaccccagcaaatactgtgaaatatacagaacatcattataatggtgaggatgatagagatgctatgttatcagaatacctgggcttgaaccagctccccttcttgcaagctgtgtgacttggagctgatgcccaaacctctgtgggcctcatttgtttcatctgttcaatggggataataacactcttacttcatacagttatggaggatttattgaaataattgacatacagctcttagaacagtatccggctccttgtaagcgctcaagaaatattacagactgttgataataatgcaatactactaccaataatatggccaggagcaatggctcacacctgtaatcccagcactttaggaggcagaagcaggctgattgcttgagcacgggagttcgaggccagcctgggtaacatagggagactctgtctttacaaaaaataaaaataaaaatacaaataattagccaggtatggtggtgcatacctgtagttccagctacttgggaggctgaggtgggaggattgcttgagcccaggaagttgaggctacagtgagctgtgatcacaccactgcactccagccagggcaacagagtgagaccctatctcaaaaataataataatggccgggcgcgctggctcatacctgtaatcccagcactttgggaggccaaggcgggcagatcacttgaggtcaggagtttgagaccagcctggccaacatggtgaaaccccatctactaaaaacacaaaaattagccgggtgtggtggcggggtgcctgtaatcccagccactcaggaggctgaggcaggagaatcgcttgaacccgggaggtggaagttgcagtgagccgagatcacaccactgcactccagcctaggtgacacagtgagactccatctcaaataataatatgagtaataataataatatcatttttatcatcattcttactaacagtctctcactccttgccctgcagttttgcctgttttcttggaataacactcttccacacctttcccctcagggatggttcacgtttagcatcatgacccacccctggggattagttagctcatttctggaaagcactttggagctgtaggtgctttgcaggctggaaacatcacgggacttgtaccatatttaagcaatgccagattattctgcctggcagggggaggacacagaggatacggccctggtatcttttctccctgcctacctcagctttgctctgaaccattttctgtcctgttcagggcagcctgggccacttgccacttccagctttctcgggagaggatgccttcctgatggcacgcctcttaacacacacctggtgctgttgttgaaaaagcaacaattgactccagcgccagcactgagaggcttgtccttaaaattagcaggagctgttggaaggtcgctgttagctcttttgactggaacacactgttccccaggtggcatgaggctgaatacagtgcagggattggctctgctctcaggtggcctgctccacgctcctgagctccgggtggaagctgtgaccattatttccttaacagaaacatatatagcagcattaactatgaaccttattactgtgtgtgtgtgtgtgtatatgtgtatatatatatatgcacatatgtgcatatgtgtgcctatgaacctgttctgagcactttacaaatgtcaatgtattttatcctcccaacaacccattttataaataagacttgaggcacagagaggttacgttactgccccaagatcacacagctggagagtggtgaggccaagatttgaacatatgtaccattgtaccatatgtaccaactttttttttctttttgggatgcattcttgctctgtcacccaggctggagagcagtggcatgaccacggctcattacaacctcaacctccaggttcaagctatcctcccacctcagcctctcaagtagctaggaccacaggtgcataccaccatgcccagctaatttaaagtttttttttgtttgtttgtttgtttgtttgcagagatggggtctccttatattacccaggctggtctagaactcctaggttcaagcaatccccccacctcggccttccaacatgctgggattacaggcatgagccactgcacccaggtcctccctccttataaaggtcgccaagcacaatcttgtgagcctggccctatccacacccatacgcaacatggtgtgtatttttcaaacaaaaactgaatgaacacctctggtttgggttcccctcacacttgtcccgggtttgttgactctgtgttgtgggcctagacaaagcagtgtctggagctcctagacccagggaccagacagtctgggttcaaatcctggctcttccacttctgcctgagtgctctctctgaacctgtctttctttatctataaaatggagataatttttttaaactcatcacttggtcaaactgctttgagcatgcaaatgagttcatatgtataaacctcttagaatgtcccaggcaaagaacaacacttcactcagatcaacatttatttagcatctactgtgtacccatgactattctaggtgatgaggagaccctctggttcttatgaggtagtgaggtgggggagggtgagaaccctaaacattaacgatggtgtgttcgcaggtgggaaaatcagtaaagtcgggtaaagggaatttgggagtgctgtgctcaagtcctggccctgccactttctggggtgcaagatacagcattgaatagggtggtcagggtaggccttattgggaaagtgatatttgagcagacgatctagatgtcggcacatattgctactgtttgatggtactaatatgagtttgagtttcacttgcaagtatatatatatatatatatatatatatatatatatatatatatgtgtgtgtgtgtgtgtatatatatatgtgtatatatatgtatatatatgtgtgtatatatgtatatatatatgtgtgtatatatgtatatatatgtatatatatgtatatatatgtgtgtatatatatgtgtatatatatgtatatatatatatgaaatttggtccatttatttatgctgatcaattaattgatgttgaaattataattgaatgttttattaataaacagatacccacatactattttttcagaaattgttaggttttggggttttctttagattttgattatttttatttgcttaattttcttttttcttttttttaattttatttttccataagttattggggtacaggtggtatttggttgcatgagtaagttcttcagtggagatttgtgagaacctggtgcacccatcacccgggcagtatacactgcaccatatttgttgtctgttatccagtgctcacctcctactcttccccccaagtctctaaagtccattgtaccattattttactcacccacattctttggcctgagatgctgagtggtcatgactcccagatcccttcttgtttctgtatcaaagatctttactaagatcctggcctagggaacctattccctttcctcatccccaatgggagaaggggcttcttccccagcttatttgccaactcataggaaaggtatgaaggagaggactgtagttgtcttgaagctggtcagatgttgaagagatgataatatttgctgatcaagagagacaaagcaatgctggaagaagaggctgtgttagttaacaccagctgcaataaccaataaaaccaaaaatctctggcttaagagtatgcatgagtgagaaatcaacttctaaagtacaactggtggccggatgtggtggcttatgcctgtaattctagcactttgggaggctgtggtgggagggtcgcttgaccccagtagtttaacgccaacctgggcaacacagtgagacaccatctctactaaaaataaaaaataataaagtgaaactggtgaggggtgcaatgaggtggagtggtgggtgactcaaatatggctcgactccatgcagtcactcagggatccaggctgttggaggctctccctgcttaaacatgtggcttccaaggttgttctaagagcctacattgagacagcagctggggaaaagggaaagtggagtgggaggtacttatgagggttcctggaagtggtgaacaacacttctgcctgcattctattgggtggaatttagtcatgtggcccaggctagctgcatgggaggctgggaaatgtagtctctgattaggctgccatttcccagtcccacttgtgaatctttagtgggaagctcaccatgtttgcaccagggattcagtctacctcccactcatgcctcaactatgtatcaggcactgtcgtaagtactttacatatcagcctacctaatgcaaacaactactcagtgggtgctttattggtcacatgtattagtgagaacatggaaacccagagccgttaaatatcttgcccaaggtcacacagctaggaagtggcagagttggaatttgaatccaggaaatctggctgcagagccccacgcttagtataaattcattgtagtttagaaagaggcagaaggaccctaaaattggcataatccattttttggtccctaaggaactgactgaattgactacttgtaaaagtgagtcctggacaggcaacagtggctcaggtctgtaattccaggactttgggaggctgaggcgggcagatcacctgaggtcaggatttcaagaccagcctggccaacatggcaaaaccctgtctctaaaaaaatagaaaaattagctgggtgtggcggtgggtgcctgtaattccagctactcaggaggctgaggcaggagaatcgtttgaacctgggaggtggaggttgcagtgagcaaagatcacgccactttactccaacttgaatgacagagcaagactctgcctcaggaccgccatggccccctgggttctaggtcagagtttctccgccacagcactgatgactttgggggctgcattattagctccaaaatgggagctatcctgtgcactgcctcaacttacttgatgccagtagcgcccgcgccccagttgtgagaaccaaaaatgtctccacacattgccaaatgtcccctgggaggtgaaatcacccctggttgagagtcactgttctagattgttaaatattatcttacactctagcacaagtccaaggcaaactgacttagaaattaccaaccttgcaaaaaatagaagatttcttaaagtcagtgagcatgatggtggcaagctgctgaaatcacacccccagacattagcagatgggatctggacagtattcatctagttaaaaattgacaaggactgggacactgcaggctcttcaaaagagaatcatttgaataacaaggggtcaagacaggggtaattggtgaaagcccctgctcataatttgaaaatataaataggcatcatgaaaattcatcctgcaaaagtcaaaagtcgaatgtgcagtgttatacatgatcagttgatttgggaggggaaattgcatgcacacacatgagagcttgcacacccacacacacacacctgttcaagtgtgtgtgccagtgctcagtgaggaccatctccccaacctgtctgatcatcttgctttggggtgaccctatgggtgaggcagaaattcttggatcatagttttctaatgaatattataattgttaacttctgatgggtgctgactttttcatctttgcaacactgcgtaggtatttttactctccccattttacagatgagacaactgaggctcagaaagattgattagctctacacgaagccaggatccaggcttagcctggctccaggaatcatgttttgagttacgtagcttccctgattctgagggacctccccacttctgaaatcttctactgttactccccatggccctttcctattgaccggaggcaccccagctcctcactcgtcccttatcttatgaaacatgaccatgatgtctgaattcaaaggagagcctgggctttgtggggaaaacgaagcagaaaaagaaaggtggaggttggtggttgtttttggcatggtgaggagcctgtcgttgcttgaggaaagcaagaaaggagattgctggggcttggatccatctctgggtgcctgtgggtctgtctgtaaaaatgagaactggtcgtgctcattagaggatttgaccgttaggccttgggatagcgatttgggaacttttttctgctaagacaaagaataatatggttcaggttcattttgctcctgctttcccaagccctacatctcttctgggcttttttttttttccttttctctccttcttcttcttcttcttcttcttcttctcatttttggatctggacttctgctgactcatctctctgagcaaggaaggagggaggaagtcagaattgctcattaaccgttttctttagtgactcagctgtgattcacattttaattaatggaggagaaaaacctgatcagtcctaaggcatctgcccaatcacgcataactccaggctggtgataataataatacttgaaaaaagtggggtgtcctgaattaaactatggctcattccccacattagtcttgaggactccaccaggccctctaagttccaggtctcaatggggctccctgaaccagagcagctagtccaagccccgagcagcatttctgcagagttagtctgaggtcaggacaagaaacagaggctcaagccctcctgggatcgcaggaggatcatgggaatgtaatattgtttcctgagctggtctttggctataatcccaggctcaagcctggcctccctcccctcggggcctgaaatttgtcagagcctattgcaggggcagcttctgtgctttttgtttgcccagagaatgagaaaagtccagataatcatgaccgctacttcctgagcacttactatgcatcaggtggtgtgctcagcacttctcatgaatgatcacgttgaatcctcactctgtccacaaaaagaaagagcttttatataattctccaacctccctatgaggaaactgaggcttggcaattgcccaatgtagacaattagtaaataatcaggcaggatataaacccaaccctttcccacctgggagccagagcttgcatctactatacttctctgctttccagtcagctgcaaagaaaaattggaagctgatagctcattcaacaaacacttattgaacccttccacctgctcagccctgttctagacaccagagatccatcagtgaaccaaagaggcaaatccatggtctcatgaaactgacaatttacctgcccaagtgtattagttactgtttataagttcctattaagtgtattagatatgcttgcagctgtaacaaagaatcccaacatgcataagggctcaaaacaataaaaatttcgttcttgcacagataaagttcaaaaggtgtattctttttttttttttcttttgcgacggagttttgctcttatcctccaggcatgagtgcaatggcccagtctcggctcactgcaacctccacctcctgggttcaagcattctcctgactcagcctccccagtagctggaattacaggtgcccgccaccacacctggctaattttttgtatttttagtataggtggggtttcaccatgttggtcaggctggtcttaaactcctgacctcaggtgacccacctgcctcggcctcccaaagtgctgggattacagccgtgagccaccgtgcctggccaaaaaaaaaatgtattcttaaacagcaggcacctctcctctaagcagtaagtcaggggcccaggcttgttccatattgtagctcctcatcttcaacccatggcttccaaagtctccatgcttcttgatatcaagccacagaagggaaaagagcatgagaagggcacaggagaaatgtttctgggacagacccagaagtagtccatatgacttccatctacctcccactggctagagcttacatggcggcacccacttgcagagctgggaaatggagtctaactgagcatccaggaaggagagacagacatgagtctttgcgtgggtcctcactgagaatcaagctccacattttgatcgatgtcaccagagcgtacatggcggcgcccacttgcagagctgggaaacggagtctaactgagcatccaggaaggagagacagacatcagtctctgcgtgggtcctcactgagaatcaagcttcacattttgatctgtgtcacctccttgcaagccctaccttaggacaattttaagggacattcctatcttcttccacccttaggacagttttaagggacactcctgagttcttccacccacctcctctgtttcttgggcttccagctctcaggatttgcctttgccttacaatggggtgaagcaagaatctggaagaatgtctctccccacaatttgaagtcttatttgaaaaaaagcagtagagcatccctccctcttgaggtagggaaatctagaatcaaatcctgcttctccagactttgacctcagaaactggggggacttcaaggtcttcaggtgggcagctttcatgaaccattcattcctcccacctcataccaatcagggtcctaacaggaaaaagaattaacttctagatggttcaaaagaagaccatgccatgaagagactccttaaagagataggaacaggtgagagaaatagataacggctgtttgaggtcctcagagagaagccatcgcgagccctacatttcctggaacccagtggaggcagagctgtgcagaagggactactgtcagaaccagggagggagcagggaagcaatattccaatctctttccctcccctcatcttctgccagcgcttcccctcagccaaaccaaaccggaaacggagcaaagcattctgggagttgtagtcttcaagggtccgcctcgagggcacagagcccgctggagcattgacctagagggcacacagggaatgactagtttgcaccatcatgtgacggactgcacgccctcgattatgtaatccactctataattcaactgcagagctgcatggtacagcaggatagccactagccacacgaggctatttaaatataaatgtacattcattaaaatttaaccaaatgaaaattttagccactgagccccatttcaaatgctcattagccacacgtggctcttggctaccatattggacagatcagaatagaacatttccatcatcccagaaagttctaggggccggcgcagctgtggtgtaacctgagcccatgcatgttatggaatggagaagagagaaaacagcacaagaggcagttttgaagggagacagagagctgtggatcagtagggaggagactctctaggcaaaggagcagttgagaagcaagaaagttgagtgagctgctttgctgcgatggaggcttccctcacggggaagagtagagtcagaaagctttagttcaagttcagctctgaaatgaaccaatgagtgttctgacaagacacctggccttccggaaccttggttttgtagtggccaagggcttgaccctctgaaggttcactgaaaaaaatcaactcacaaggcatattaattggagaaaaggcaggcagatttatttaatgtgtttgcacgagagccttcagaatgaagacccaaagctgcaggggaaattgtccgttttttaagcttaggttcaacaaagtatggacagcggtgtagaaatatgattgaacaaaaagtgtacaatgtaaatgctaatagactgagtggggaaacccaaaaagggctgtcttgattctccttggtctctctgagcatgcatttcttccgggtatgggacaagaccctctctggaatggagggggggctctcttggttctccttggtctctctcagcatgcattccttccgggtatggggcaggaccctctctggaataagggggctgtcttgattcttcttggtctctcagagcatgcattccttctgggtatggggcaggaccctctctggaatgggatccttataacctacggtcaaataacgtaagttagataatttcttttttttttttttcttttttttgagacagagtctgattctgttgcccaggctagagtacagtggcacaatctcggctcactgcagcctctgccttctgggttcaaatgattctcctgcctcagcctcccaagtagctgggactacaggtaagcaccaccatgcccagctaatttttgtattttttagtagagacagggtttcaccatgttggccaggctggtctcaaactgctgacctcaagtgatccaccacctgggcctcccaaagtcctgggatttgtaatcccagcatgagccactgtgcccagccagatcatttctttttctttttctttttcttttctttttttttttttttttgagatggagtctcactctgttgcccaggctggagtgctgtggtgcaaactcagctcactgcagcctctgcctcctgggttcaagcaattctcctgcctcagccttccaagtagctgggactagaggtgcgcgccaccatgcccagctaatttttgtatttttagtagagacagtgttttgccatgttggccaggctggtcttaaactcctgacctcaagtgatccacccacgtcggcctcccaaagtcccgggatttgtaatcccagcatgagctaccacagctggccagataatttttttataactagtttttacaaagaaaggtggagggaaagttagagtaacatttttaggtgttagggctgactttggggaaaagaggtctggtttctacgacccgccttagggaagagggattctagtttttgtggctagccccaggggagaatgggactaagagatagaagggcaggagaaggtcagagaaaaacttttgcttctgtggctgcttcggagaacttcattttggggtattgttttctgagccccaacagtttgcttatcagtgaagtgggtataggcgcccacctcccacagtgacgatgctgtgaacagggctttggaagagtagaactatgaaatatttgttgttgccttgtggggaaatggtcgttaaagccaaaattgttcaagagaagaagcaggaagagttcctttctttcctgcaggtatcctcttaagctgagtcttcagaatcccctgacaacgtttaatcaacactttattaaattcaccccaaccctgcttcaaaccttcacctggtcctcgagatcttccaactgtttcttgatgaagttagcaggcaattgtatggcgggatcatcatctcatgttttgttttgtttttttcctttttaccctctgactttgagaaatccttgtccttttacttttccaaacctgagagcattgcagagaagttagaattgagcaggacatgggcttaagacccagcccagccatgtgctagctgtgtgaactcgaagcagtgaccccacctctctgacctggaaagtagagggaatgataggacccaccaccgccacacttgtagggtcatcatggggattgaataaaataatgcataagacttggcccacagcaagcactcaagaaatgttagctacttcctaaatatatttttaaccttttattgaatataacatacatacagaaaagcacatgtatcatacaagtagagcttgagtgattttcaaaaactgagcccagtcatgtaaccagcgcctagttcaagaaacagaacatagccgagtgaggctgaggcaggagaatcacttgaatctgggaggcagaggttgcagtgagcagagatcatgctatcgctccccagcgtgggcaatgggggcggaggggaagagagagagagagagagagagagagaggaaggagggagggaaggaaggaaggaaggagggagggagggagggaagggaaggaaggggagagagagaaaaggaaagaaaagaggaagacagaaagagagagagaaaggtaaagaaagaaaaggaaagaaagagaaagaaagaaaagaggaagacagagaaagaaagagaaagctaaagaaagaaaaaaaggaaggaaggaaaatagggagggaagaggaggaggaagaagaagaagaagggggggagggagggaacagctgcagcttcgaggaaggaaggagggagggaaggaaggaaggaaaggaaggaaggaaaaaaaaacagcaccaacgtttagaaacccccttgtgcctctgaggtcaccagtaactccatcctgacttcaaacagtctagattagttttgcttgtttttgaactttaagcacatggggtcatacagcatgcatgcattgacttctttcccttgacgttgtatgtgtgagattcatctgtgctgttgctgttcatttgttctcatcgctgtgtgtgctgaaccacctgttcatttactctactaatggtgggcagtttggtgctttctactttggggctattccagagaaagctactttgaacacactcagatatgtctgtgggtgaccactcttcatatttctatgggagatattcctaggaccggaacatctgagtcagagggaggaattggtttagctttggtaggaactgcctaacaattggccgggcacagtggctcatgcctgtaatcccagcactttgggaggctgaggggggcaaatcacttgagctcaggagttcgagaccagcctggccaatgtggcaaaacccctggccaacatggcaaaaccccgtctccgcaaaaaaatacaaagattagccgagcatggtggcgtgtgcctgtaatctcagctactcaggaaactgaggcaggagaattgcttgaacctgggaggcagaggttgcagtgagcagagattgcactactgtactccagcctgggtggcagaatacatgaaactccatctcaaaaagaagaaaggaaggaaggaagggaaggaaggaaaggaaactgcccaacagttttcccaagtgtttgggatggaaggaaggaaggaaggaaggaaaagaaactgcctaacagttttcccaagtggttggaccagttaaaactcccaccacctgtgaatgagagtttgtttttattttgctcctggagtgcctctcctgtagcaggttcccactgaatgtctgggaattcaaatgtaatgcacttgttcatttcctcaagagcttcactccatcaattggattcatccattggctctcccatctccactgacactatgttctcacctctatttggaagacatcctgcctccacctgcccaagtcacattatcttctcattccagcctctcaaggagagttttctctttcaccacctcctctagccctggtgattggcaaggtctcgcaacagtacccttcaaaacactcatgactgtgaatgcactggccttcactaagtttcccattcttctctttctttcttttttcttttcttttctttttttttgaacagagtttcactcttgttgaccaggctcgagtgcagtggcacaaacacagctcactgtagcctcaacctcctgagctcaaggtatcgtcctgcctcagcctccttagtagctgggaccacagacatgcaacgttgtgcccagctgattttcttttttttctttttttttttttttttgagacatggtctcaccctgtcaaccaagtgcagtagcatgatcacagctcactgcagccttgacctcccgggctcatgcgattctcccacctcagcctcccgagtagctggggctacaggcacaagccaccatgcctggctaatttttgtacttcttgtagagaccaggtttcaccatgttgcccaggctggtcttgaactcttgggctcaagcagtcctcctgcctcagcctcccaaaatgctgggattacaggtgtgagccagcacgcccggccatggctaatttcttcatttttggtaaagacaggtctcactttgttgcctaggctggtcttgaactcctggactcaagcaatcctcctgtctcagcctcccaaagtgctaggactaccgatgtgagccaccgcacccggcaatttccccttcttgacttctccagagctctcatccctctcgagctcctgtctcttctagaatcacttacctcaccaccttatggggtttttgcctctgttcctactcctctttatttaagaaaacactgtactttaagagggcttcagaaaccacccgaaatagaaacatgtccttttgttcaatcctttactttaaaagacaaataaaatgaagaattgctctccatgtagaaggttaaggagcttgggaggaccttctgtgagtggggagaactttacattaaaggaaaaaaaatgctggagaatagctgtgaacccaggaagggagaaggacttcctccactgaacttgtaaagcacaaactctaaggcaaaaaaagacatgattacatgaaaactaagatatttgttcaaataaagatgcaattggggccaggtgcggtggctcacgcctgtaatcccagcactttgggaggccgaggcaggcgaatcacgaggtcaggagatcgagaccatcttggtcaacatggtgaaaccccatctctactaaaatacaaaaaattagccaggaatggtgtcacgtgcctgtaatcccagctacttgggaggcttaggcaggggaattgcttgaaccagggaggtggaggttgcagtgagctgaaatcacgccactgcactccagtctagcgacaaagcaagactccgtccaaaaaaaaaagatgcaatagcaggtggttcgggaaccaaaccttacatccagatgctggttgtcccatttcctgtgaatccttgggtgagttatcaacctctctgagcctcagtttcctcgtcaataaaatggagaaaatagtatctacctatggaattgttgtgagttttgaatgagttaatatttataaatcatttagaataggaattagcacatggtaaatagtggatagaatcataaaaaaaaaattgatcaggggttaacttctaactgctgtttgttatagaggtccctagcactgtgtggtcattttaaatttagatgatttagaattaaatgaaatttaaaactcagttcttcattcacactagccacattttaagtgctcaaaacccacaggtgactagtggctaccatatttggcagcacagattgagaacagatttatcatccagaaagttctgtcagacagtgttgatcaaggctacatgagggtctgggtgcagtggctcacacctgtaatcccagtgctttggaaggccaaggtgggaggatcactggaggccaggggtttgagaccagcctgggaaacagagagacctcatctctaccaacattttaagaattagccaggcaaagtgttgcatgcctgtagtcccagctactcaggaggctgagacaggattgcttgagcccaggaatttgaggctgcagtgaactatgagcgcaccgctgcactccagtctgggtgacagagtgagacctgtctctaaacataaaaaataaaaatgtaggtggggcatagtggctcccgcctgtaatcccagcactttgggaagccgagatgggcagattgtgaggtcaggagatcgagaccaccctggctaacatggtaaaaccgcgtccgtactaaaaataaaaaaaaattagccaggcatggtggcgcatgcctgtagtcccagctactcgagaggctgaggcaggagaattgcttgaacctgggaagcagaggttgcagtgagctgagattgcgccactgcactccggcctgggcgacagagcgagactctgtctcaaaataaataaataaataaataataataaagtaaaaataaaaatgcaaagactacctgagggaatgtctgcaagtcaaccagaataacacagcaaccccaataggaaaacaggccgaaaatgtgaacaggcggatcagggaagtgaagtctgaaaagctaatcagcctatgacatggtactcaaagtcatttgtaaccagaaagatggaaatgaaagcagtatctctgtacacctttaatattggggaaaaaatatgtgaataagccaagggtttccagcgatgcgggcacagaggaaagtcttgcaccactcaaaggggtgtggcccagggaggccactctggagacatatcggtagtactcagtccagtgaggtccagcaccatcagcgcttatgtccccaggcatccatcccagggacattcttaccaggtctgttaggggcaggtacgagaatgcttactccagcaccatctatataaggggagctgaaggccacctggtgtccctcctggagaccaggaggcggcatgtgacagcggcacccatggagcaccagaatgagtgagagctccagaccgcatatccgacagatactacgggatggggcttttagaaatatggttgttgccgggcacggtggctcatgcgtgtcatcccagcactctggcaggccaaggcgggtggatcacctgaggtcaggagttcgagaccagcctggccaacatggtgaaaccctgtctctattaaagatacaaaaattagctggacgtggtggcgggtgcctgtaatcccaactactcgggaggctgaggcaagagaatcgcttgaacccaggaggcagaggttgcagtgagccgacatcgtgccactgcactccagcctgggtgacaagagcaaaactctgtctcaaaaaatttaaaaaacaaaaaataaaaatatggttctgggtgaaaacaggaaacaacagaatgtgtctaacttcatcctgcttatgtcagttaaaaatagacacactcaaaatatcgcacgtgtttttgcgagaatgcactcctataaggccaaattaaacattctctcagttgtctctgggagggagaagaatgaaagtagggtatagagagatataggggaattaatgcatgaatgaatgaaggtataaacaagagacaggcgtcatacagaccaaaggtaaagatatcccgtaacctgaggagagcaaagaacttgactctgcatttgaagattcagaaaatgaatttcagaaatagttttctcgccagggggtggctcacgcctgtaaccccaccactttgcgagggcgaggcaggtggatcacttaaggtcaggagttcgagaccagcctggccaacatgatgaaaccctgtctctactaaaaatacaaaaattagccaggcatggtggcatgtgcctgtaatcccagctactcaggaggctgaggcaggaaaatcacttgaacccgggaggcagaggttgcattgagctgagatcacaccattgcactccagcctgggtgacagagcaagactttgtctcaaaaaaaaaaaaaaaaaaaaaaaaaaaagaagaggaagaaatcgttttttcaagaaggggaaagctgggtgatttaagaatgaacttgaagaggatcactcagtcctcaacctaggagtggcaagaatatagactgtatgggaagtggttctgctccttggtacccatcttagaaatatttggcctgagtctgtaagaggcaggtactttatctaacctgaggttagggggccactacatccccatcccctcccctgctttctaaccatgctaacatcttctcactctcctgtctcctctccttctcactcccctaatctgcctattcacattttgggcctgttttcctattggggttgctgtgttattctcactgatttgcagacattcctctgtgtcatctttttaattttgttttaatttttagaggcaggatgtcattctgttgcactggctgtagtgacgtagctcactgcagcctcaaactcttgggctcaaactcctgtcctctgcctccacttctcaactggtaacctcacttctcttcatgaggtctctccagccccagggcctttgcacatgttcccctctcttctgagtggcatatggtagttgctcctctgtaaatatttattgacatcctgacttccaaccagcagagaattgacctccttcccatgctcaggctagtgaaggcatgagtttggctgaggtcccagtggggaaggtgagtggggtggcagagttaaccaggagcagcatggtagaatgggtaaaaccagacgtagcacgcaggcaccacatgttagctggacaagtagtttaaccccatgggtctcaatttccccatcaatgaaagggagaatagaacaagtccctggtaagcagcataaaatgagctctcagaatgtaaagtaacaagcacacaacctggaagagaatacatttagtgaatattggctcctttaatcagcaggttctgatatgacttagctacaattaagaaaataaaaatggaggccgggcgcagtggctcatgcctgtaatcccagcactttgggaggccaagacgggtggggtggatcacctgaggtcaggagtttgagaacaggctggccaacatggtgaaccccatctctactaaaaatacaaaaattagccaggcgtggtggcgcacgcctgtagtcccagctactcgggaggctgaggcaggagaaacatttgaacccaggaggtggaagttgcagtgagcccagattgcaccactgaactccagcctgggcgacagagtgagatttgtctcaaaaacaaaagaagtctggaggccaggaggttggttgcagggttggttccttggctcaacaatgtctccaaagagtccttccatctttccactctaacatcgtcactgtaaggactttttttaacatttaccactcacagccccaagacgactgcgtcagttctttctttttttccttcagacagagtcccgctctgtcgcccaggctggagtgcagtggcatgatctcggctcactgcaacctctgcctcctgggttcaagcgattctcctgtctcagcctcccgagtagctgggattacaggtgcctgccactgcatccggctaattttttgtattttttttagtagagatagggtttcaccatattggtcaggctggtctcaaactcctgacctcaggtgatgcacctgcctcggcctcccaaagggctgggattacaggcgtgagccactgtgcccggccgatgactgcctcagttctaaggtacttacccagccatccacgtagacagacacaaaagcatccggccaaagaagagggagaggaagggctgtctcttaccatgtgactcatctcacggggaaaaaatccttttccagaagcacccagcagatttttcacccagatcctgttaggcctacgaatgggtcatgtgacaagtgctcttattgcaaggaatcttgggaaaaagagactattaggcattttctgcctctttgatgggaggtgggctctgccagtaaggcgggtagtggtggtggctcttggatggacaactgtgtcttccattcttcttcttcttttttttttttttttaagagacaaggtctcactctgttgcccaggcagaaatgcagtggcacaatcacagctcactgctgcctcgacctgccaggctcaggtgatccgcccaccttagcctcacgagcagctggaggagtgtaccaccatggccggctaatttttatattttttgtagagatggggtctctttatgttgcccaggctggtcttgaactcctgagctcaaacaatcctcctgcctcagcctcccaaagtgctgggattacaggcataagccaccacgcctggactctcttctttaaatactgagccttccacctcttctagaatatactctgttaattatcaaccacacttttctacatttttgcttcattattcattcagtaaacatttattgagtgcctactgtatgccaggcacagctttaggtgctggagatgctatgaacaaaacagatgaaaatttctaaaaaataaaataaaaaataaaaataaattttgcaaagccaggcacagtggcttaggcctatagttccacctactcaggagtccaaggcagtaggatctcatgagactgggagtttgagtccagcctgggcagcatactaggactctgtctctaaaaaagaaaagaaggccgggcgcagtggctcacgcctgtaatcccagcactttgggaggccgaggcaggtgaatcgcaaggtcaggagtttgagatcagcctgaccaacatggtgaaaccccgtctctactaaaaatgtaaaaattagccaggcatggtggcaagtgcctgtaatcccagctacttgggaggctgaggcaggagaatcgcttgaacctgggaagcggaggatgcaataagccgagatcgtgccactgcactccagcctgggcaacagaatgagaccctgtctcaaaaaaaaaaaaaaaaagaaagaaagaatagaaaatatctgccctacggggatggacatgctagaacatcaaagtccaatggaactttctgcactgatgaagtatgtatgtatgcaccagccacatgtggcttgggagcacttaaaacgtgactggtacaagcgaatttttcatttaatttaaatgaatttaaatctgtatttaaatagccatgtgtggctagtggttactttattgggcggtgcagctctctaaaggccaagagatacatcatcaacttctctcccttgacccatattcagttctctcccaccctgaaaatctcctctcctacccaggctcacatttccagttcttctcctcttgttctccctcaaccatcagcccccgcaagactgacgtgaccctgatgccgtatgaaatgcattcttcatcctttactcttactcacctctgtgcggccctggagaccagtgacctctcctttctcaaaatactttatttctgtgtgtttttgttgttgctattgtttttggggggttttcttgagatggagtttcactctcatcacctaggctggagtgcagtggtgcgatctcagcttactgcaacctctgcctcccaggttcaagcgattctcctgcctcagcctcccaagtagctgggattacaggctcccgccaccacggctggctaattttcttgtatttttggtagagacggagttttgccatgttggccaggctgatctcgaactcctaacctcaggggatccacctgcctcggcctttcaaagtgctgagattacaggcatgagccaccgcacccagcctcaaaatgcttttgaacttgactgtcaggtatgccattctccacaccagtctcctcccatgtctgtgtcttctccctctccactggggacccttggctttttccacttcactcatctaccctgggttatctggtcttccataaccctgtcctctgccacacctcacttattcacccaccacaatatttattgagtactcactaggccatgaaagatgctatacaaaaaaagcccctgtcctcgtggagctgacattctagaagaaagcatgaataataaatacgacttaataaacagtacggccaggcatggtggctcacgcctatcatccaaacactaagagaccaagatgagaggatcacttgaatccaggagtttgagaccaccttgggaaacgtactgggaccctgtctctacaaaaaaaatattaaaaattagctggatagggtaatgcatgcctgtagttccagctacttgggaggacaaggtggaaggattgcttgagcctgagaggtcaagtccgcagtgagctgtgactgtgcactgcacgccagcctgggtgacagagtgagatcctgtcttaaaaataaataaataaacaaacaaacaaacaatataattccagagagtgaagaggcaggatctctttagctaggaagttgagggatgttctctctgagaaggcagaatctgagtttcaacctgaagaattcgaagaggccagctaggcaaaagatgagagttgaaggaatggggacggcagaggagacagccaatatagtaattctcaataaagcagaaagtgagcttttcctgctggcagaacagaaaggaagtcggagtggccagggtgttgtgggacaaggtggtcagcaggagtcacatcacgcaaggtcatgtggtcatggtagactttaaattttactccaagcctgatggaagccattggaagattttaactaaggagtgacggaaaactggcatctcaaactcaacatgtctacaacccagttcttgatctttgaaaccttcttcctccatcttccccatctccattgacagcaacttcatccttcagttagctcaggccaaaaccctggagtcacccttgatacctctctcctgctccacactcagtctttccattggaagccctaggggctgccatattgttctccatagcacttcacaccgtctgacatactatatcttttcccactattgctttgtccttggtagcatctttaggcactctctgaatatctggcacatagtacgtgctcactaaatccttgttgaataaatgaatgaacatcactccgtggtcctttcagaaccagagccattcttctctttcttcaccaccgttgcccctcaccccgcccaactagtcacaggagttgaaggatgacacagtagagaactgggattctggagtcctgtggctggtctggggttcgagttcttactcagtggtaggaacctccatgtgggattaacttatctggtctttagtttcctcctctgtaaaatgggcctcaaactgccaaccgctgggatgcagggaggatttgatgagcccaggcaggctccctggagcacagcaatcaatggcagctatatataaaccggggcctcttttgtactcccactgcctttgtcctagttccagccctcattacaccagcctgctcttgcggctccctcctaacttctgctccatcaccaccaatctgtcctttcagctgtcaggcttgtcttctgaacgccaaccctaatcacatcccttcctgctccaaaaccttacatgactctcactgtccacaggacaagacccagcctctagttgacagcctccactgtccagcttacccaacctctcccctaccacataccctgagtggagccttctgcctccatagggctttcttagccagagaagcctcccttatcttcctgttctcctcctaattccttcttatccttccagggaggaggctgtgaggtaatgcatcttgggagccagctgggattgcacagggtggtgagattatctgcatttccgaggcttgaacaagttaaggcaatgggaaaggtcacacaatgagaaaatgcagggccaggatttaacccgtctgagatgttctgactgtgctatgctgcctccccggacatgagctctgcgataatgctgtccccaggctgtaatcattccctctttcatccctgcctcctctatccctggggtcagagggacttgtagttgaatctctcactcactcattggtgtggtctctccctaaagcagggtggagtttgtcttagcgttatcactgcatccagcacaacctccctggtccaggcttatcagcgttcaactgcgtcaatgcagttgcctcctcctcaatctcccagcttccggccttgccccctagagagatcatattttaatacaagtcagattacatccctcctcccctcagaaccctccatggctcacaccttactcagagaaaaagccaaagtcctctccacaacccacaaagccctgcaccatccatcacctcactgccttcgtcccctcacaccctcccccttgctcgctctgcttcagccacaccaactcatctctgtttctcaaatacaccaggcatggcctagctattaaatgcacggtccagcctggtgcatttgaagaacacggatgaattggtgtggctggaacagagtgagtgagggggagagcgggaggaggacctttgcaccagctggacctttgcaccggctgttccatttgcctagagttttccctgacatattcatatggctcactctcttgcttcccttgctttctcccagtctttattcaaatgtctatttctctgcacttgtgctgtttgatacagtcaccgctggccacatgtggcctttgagcacttcagttgaaacacatgaaagtgtagaatattgaccagattccaaggaaaaccatgtgcaaaatatcttttatctcttaagatacagggtctcgctctgtcttccagcctggaatgcagtggcacgatcacagctcactgcagcctcaaaatcccaaactcaagtggtcctcccaccaacagcctcccgagtagctgggattacaggcacacaccacaatgccccgcccatttttttaattgttattattttttttaatagcgacaaggtcttgccatgttgctcaggctggtctggaactcctggcctcaagcgatcctcctgcctcagcctcccgagtagctgagattacaggcaggagcttttgtgcccagcaggtctacgatcttcttagaatgcttcaggctgggcatagtggctcatgcctcaaataccagcactttgggaggccaaagcaggcagattgcttgagctcaggagttcgagaccagcctgggcaatatggtaaaaccctgtctctccaaaaaaaatacaaaaattagctgggcttggtggctcccacctgtagtcccagctacttaggaggctgaggaaggaagatcacctgagcccaggaggcggaggttgcagtgagccaagattgagccactgcactccagcctagacaacagggagaccctgtctcaaaataaataaataaataaataaataaataaataaataaataaacaaacaaacaaacaaaccaataaatgaattttacctgtttctttttacttttttaatgtggctactagcaaattttaattttttttttttttttttttttttttgagacagagtcacgctctgtcacccaggctggagtgcagtggtgtgatcttggctcactgcaacctccacctcatgggttcaagcagttcgcctgcctctgcctctgagtagctgggattacagatgcccaccgccacgcccagctaattttttgcatttttagtagagatggagtttcgccatgttggccaggctggtctcgaactcctggcctcaagtgatctgcctgcgtcggcctcccaaagtgctgggattacaggcatgagccaccgcgcctggctataaaatttcataagtagctcttaatagatttctcctgggcagtgctggtctaaacactttttttttttttttttttttttgagacggcatcttgctctgtcaccaggctggagtgcagtggcgcgatctctgctcactgcatcctctgtcacccgggttcaagctattctcctgccttagcctcccaagtagctgggactacagacacccgccaccacgcccagctaatttttgtatttttagtagagacgggttttcaccatattggccaggctggtctcgaactcctgaccttgtgatccgccagccttggcctcccaaagtgctgggattacaggcatgagccaccgcacctggctataaaatttcataagtagctcttaatagatttctcctgggcagtgctggtctaaacactttttttttttttttttttttttgagacggcatcttgctctgtcaccaggctggagtgcagtggcgcgatctctgctcactgcatcctctgtcacccgggttcaagctattctcctgccttagcctcccaagtagctgggactacagacacccgccaccacgcccagctaatttttgtatttttagtagagacgggttttcaccatattggccaggctggtctcgaactcctgaccttgtgatccgccagccttggcctcccaaagtgttgggattacaggtgtgagccaccgcgcccggccctgtaacacttttaacactgaactgtttgccttccaggtggtaaagagcaggtgcctttactgatagaaatgtcaccactcccttcatcccgccagccccatgtcactgacgcgtcctttccccttgctctgtggtaactttctcctaagcactcatcgccctaacatctgtcatacaggtatacctcagagacactgctggtttggttccaggtcgccataacaaagcgaatattgcaataaagggagtcgtgccttttttggtttcccagtgcacataaaagttatgcttacactatagtctgttaagtgcatgatagcattatgtctaaaaaaaaatgtacataccttaattttaaaatccatcaaggctgagcacagtggcttgtaatcccaacactttgggaggccaaggcaggaggattgcttgagcccagggatttgaaaccaggcaacaaagtgagaccccgtttctacaaaaaaattctttttaaaaatagctgggtatggtgacgcatgcctgtggtcccagctacatgagaggctgaggtgggaggctcacttgagcctgagagattgagactgcagtgagctgtgatcacaccactgcactctagcctgggggacagagtgagaccgtatctctcaacaaaaattaaaaaaaaaaaaaaaaaaggctgggcacagtggctcatgcctgtaatcccaacagtttgtgaggccaaggtgggtggatcacttgaggtcaggagttcaaaaccagcccagccaacatggtgaaaccccgtctctatgaaaaatacaaaaaaatagccgggtgtggtggtgcacacctataagcccagctactcgggaggctgaggcacgagaattgcttgaacctgggaggcgggggggagattgcagtgagccgagattgcactgctgcactccagcctgggtgacagactgagactctgtctcaaaaaataaataaataaataaataaataaataaatgttttattactaaaaaagttaacaatcatctgagccttcagtgagtcctcatcttgctggtgaagggtcactggctcagtgttgatgggtgctgactgatcgtgggggtggttgctgaagattggggtgcctgtgacattttcttaaaataagacaagaaagttttccgcatccatcgactcttcctttcacgaaagatttctctagcatgagatgcttgttgacagcaattttacccacagtagaacttttttcaaaattggagtcagttctttcaaaccctgccactgctttgtcaactaagtttatgtcatattctaaatctcatgttgtcattttaacagtgttcacagaattttcaccaggagtagaatccatctcaagaaatcactttctttgctcttccataacaagtaacgcctcatgcattgaagtttgatcatgaggctgcagcaattcagtcacatcttcaggctccacttctaactctagttctcttgctagttccatcacttctgcagtgtcttcctccagtgaagtcttgaactcctcaaagtcatccatgaggatcggaattgacttcctcaaaattcctattaatgttgatattttgacctgttcccacgaatcacaaatgttctttttgttgtttgtttgttgtggattgtttttttatttttaattgagttgaggtctcactatgttgcccagactggtcttgaactcttggcctcaagtgatcctcctgccttgatctccctaagtgctgggattacaggcatgagccactggaacagccacaaatgttcctaatggtatctagaatggtgaatgcttttcagaaagttttcaatttcctttgcccagatgcatcaaaggaatttatctatggcagctatagccttatgaaatgtatcccttaaatcataagacttgaaatagagaattacttcttgatccatgggctacagaatgaatgttgtggctgggcatggtggctcacacctgtaatcccagcactttgggaggctgaggcaggtgggtaacttgaggtcaggagttcaagaccagcctggtcaatatggtgaaaccccatcactactaaaaatacaaaaattagctgggcatggtggcgtatgactgtaatcccagccacttgggaggctgaggcaggagaattgcttgaaccctcttgaagacagaggttgcagtgagccaagatcacaccactgcagcgacagagtgagactctgtctcaaaaaaaaaaaaaaatgttgtgttagaagtcataaaaacaacattcatcttcttgtacatgcccattagaggtcctggataaccagtgcattgtcagcagtaatattttgaaagaaatcttttttctggctgggtacagtggctcgcacctgtaatcccaccactttgggaggccgaggcgtgtggatcacctgaggtcgggagttcaagaccagcctggccaacatggtgaaaccccaactctactaaaaatacaaaaaaattagccaggcatggtagcaggtgcctgtaatcccagctaccctggaggctgaggcaggagaatcgcttgaacctgggagtcagaggttgcagtgagctgaggtcgtgccattgcactccagcctgggcaacaagagtgcgacttcatctaaaatacatatatatatataacatgttatatgtaatataaattatatatataacatatatgtaatataaattatatatcacatataacatatatcatgtgttatatatatcacatataacatatgtgttatatatcacatataacatgtgttatatatcacacataacatatattatgtgtatatatgtcacatatattatgtgttatatatgtcacatataacatattgtgttatatatatcatatataacatatattatgtgtagtgtatcatatgtaacatatattatgtgtagtgtatcatatataacatatattatgtgtagtgtatcatatataacatatgtgtagtgtgttatatataacatatattatgtgttatatatctcatatgttatatataacatatattatgtgttatatattatatatatatttttttctgagtagatctcaacagtgggcttaaaatatcagttatccatgctataaacagacgggctgtcattcagtcttcattgttccatttatagagcacaggcagagtagattcagcataattcttaagaccttaggactttaggaatggtaagtgagcattggtttcaacttaaagtcaccaggagcactagctcctaacaagagagtcagcctgtcctttgaagctttgaagccaggcattgacttctcctctctagctatgaaagtcctagatggcaacttcttccaatagggcatttcatctacattaaaaatctattattcagtgttgccagcttcattaataatctcagctagatcttctggataacttactgcagcttctccatcagcacttatcacttcaccttgcacttttatattatggggacaccttctttccttaaacctcatgaaccaagatcttctagcttcagatttttcttctgcacttccccacctctctcagtcttgctgtgggcttgctgtggattaggctttggcttaagggaatgttgtggctggtttgatcttctatccagaccactaaaactttctccatgtcagcaagaagcctgtcttactttcttatcattcatgtgtttactagagtagcccttttaatttccttcagtaatttttcctttgcattcacaacttggctaacctctagcttatggccttttgtttgtttgtttgttttgtttttgagacagggtctcactccgttgcccaggctggagtgcagtggtgcaatcaccgctcactgcagccttgacttcctgggaccaagtgatcctcccacctcagcctcctaagtagctgagaccacaggtgtgcaccaccacacccagctaatttttttattttctgtagagatagggtctccctattttgcccaagctagtctcaaactcctaggctcaagccatcctctcacctcagcctcccaaaatgctcggattacaggcatgagccaccatccctggccctatctcagcttttgacacgccttcctcactgtgtttaatcatttctagcttttaatttaaagtgagagacgtgcaactcttcttttcacttgagcacttaaaggccattgtacagttatacactgacctaatttcaatattgttatgtctcggggaataggaaggcccaaggaaagcgggagagatggggaaatggccagttggtagagcagtcagaacacacacaatatttatcgatcaagtttgccatcttctatggatgtggttcgtggcacccccaaacaatgactatagtcacatcaaagatcactgatcacagaccaccataacagatgtaataattatgtaaaagtttgaaataccgtaagaattaccagagtgtgacacagagacgcaaagtgagcacacgctgttggaaaaaaaatggccctgatagacctccttgacacagggttgccacaaatcttcaatttgtaagaaacacaatatctacaaattgcaataaagcaaagcacaatgaaatgaagtcttcctcggccggtgtggtggctcacgtccataatcccagcactttgggaggccaaggcaagaggatcccttgagcccaggagttggaggccagcctgggcaacacagggagactccatctctagaacaaaacaaaacaaagcctgcttatatttattgggtttactctcagtctcccccacacagagatagggcctggcttgttattagtgctcagttgatgtttgtgaagtgaaatactaaggacttaaccactgcctgttctttgctgttcatgccctgacagcttttatgtgccagcacagaagaaaacaaggtgcaagaagagaatagtgatctctaagtcagaatttgaggaacccaaattagtaccagaaagctgggaggagaagagaaaaataaagtaaatcaaattaaaagttgaatgggccaagtgcagtagctcatacctataatcccagcactttgggaggctgaggtgagaggatcacttgaggccaggagttctagaccagcctgggcaatatagcaagaccccatctctacaaaaaaaattttttaattttctgaatatgttgttgtacacctgtagtcccagctgcttaggaggcagaggtgggaggatcgcttgagcccaggaggttgaggctgcagtgagctgttgttgcaccactatactcaagcctgggtgacagaataagtccctgtctccaaaaataaaaataaataaattcattttttgtaaagttgtatgtcatggcccctgcctactctggcttcatgacttgctgcttgaacctcaccatccaaatcccagtggtgacaccatgtcatttcttgaatttgccaagccctctttcagtcccaagctctctgtcatggccactctcagcctggaaagttctttccccactggccagatttctccccctcatctatgggaacttgacttgaagtagggggtatcccaggccctggactagttaacacgacctgctgtgtgcccctcaaagccattgtcttcctagctgagaaggcatcacacctgcaacagattcactcattgtgtgcatgtttttcttaaccacttctcttctgcatcagctccatggggcagggatagtctcatatgtcactctacccagcacataggatacgctcagacgcccacttgtggatggtggaaaaggtcagcccaacctaatatgcccatctctcctctaggggtaatcttgagaaaaaaagttgggaacttgctttgtgttagtttaggatgacccagaatagatcctgaaacaagaatttagggcaatccttgtgcaagtagttcatctgagaggtgaccccagaagggttggagaaggagaggggaggtggggcaaggaagggtgagttgtcctgtaggcaactgagctccgtcctactgggagcccacgtggaactcacctcttaagtgatccagaatgaagggtgagggagctgcggtattgatccaccaactcccagcaatctttggttgagggctgctcccttaaagttcattccctgggcctgccccagatttggagacagccctaaggcaagaggtacagataccagttggccacagactgaagtgttaagacccaagcccctggataaaactgaaaaatcaagccagatgtggtggttcccacctgtaatcccagctactcagtaggctaaggcaggaggattgcttgagcccaggagttcaatgctgtagcgagctatgattgcaccactgcattccagcctgggcatcagagcaagaccccatgtctaaaataaaaataaactgaaaaatccccaagttatttgctgtgaccaaccttccattaaccacagaccctctggtattcagcatttcttgtccattatatgaagttctgatgacagtctcttttattgtattgtgccttgaccacgcactgtacatcacttagctctgaaatggacatgttcaggaaacagggccaggtgggaccctgtgtttcaacagcaatacttttacaaatgaggtctcatgacagggtcttgctcggagggtttctatggaagcctcatcccacctactgctatcatccttactaacttgcatttacaaaagggactctttttgaccagaggcttggggtctgtagctgccttctagccagctgatgctggctggtccacacaagcaggatcacacccatttttttgttttcttatttatttctgaataggttagcataccggtaacctgtgtgcctggcattgtgctgaccactttttgtcaacttactgaatcctcacaacccttggaggtattgatactattgttatccaggttatacaaaagggggaaactgaggcacagagcagggatgtcccttgcccaaggttacccaactggaaagtggcagatctgggatctgaacccatgcaggctgggctcttaacactgaactactttcctgccatttgttaaagagccacaaaccaggccaggcaccatggctcacgcctgtaatcccagcactttgggaggccgaggcgggtggatcacctgaggtcaggagttcaagaccagcctggccaacatggtgaaaccctgtctctacaaaaatacaaaaaaaagtacccgggcatgatggcgggtgcgtagtaatcccagctactcgggaggctgaggcaggagaatcccttgaacccgggaggcagaggttgcagtgagctgagatcacaccattggagatcgcactccagcctgggcaacagagtgagactctgtctcaaaaaaataaaataaaataaaataaagagccacaaaccccgaaaggtctgccattcccccagggccccaggccaccccacaatctattgtcattgtaggttgtgaaatatactgaatgtcaccccaaccttgagccatggggaagattccatttctctcattgcaacatttgtgcaacatgaaccatctgttgggggtcttcgtaaatcaccttttatcccgtgaggcaggtactgttaagaccattttacaggtgacaaaactgaggccagtggtgtcgagtcacctgcctgtggtcacccaaccaatacaggacagcttggaatcccaagcacccccgccctgctgtctgacccccaaaacccaccctctgttctccattctggcttctttctttcagcatcttggcgacagttgggacggagtttgacctacggacgctgagggcagttcgagtgctgcggccgctcaagctggtgtctggaatcccaagtgcgtgagtttccgaccctgacaaggggtttgctcacgggccccaggagccctcagtttcccctatgcagagcatctcaggaggccacatcctgccaccagcctgtgtgagggcagtctcttctttgggactccctatagggaaccccctaggaatatgactgtagctccccatgagctcctgaaagcaaactaggagccacacccatttattgagcacctactgtctatcgggagccatgctaagcaccacgtgtgatctcattcagtactcacagccctatgaagttgataggactgatgtctctattttatggagggggaaactgaggctcagagtggctgaaacattggagcagggttttgtggctgagaagtggcagaactaggagtgagcaagtgtgactccaagcctgggccgtaccactggtggcaatgaccattcccatttaatgagtgcctgctgcgtgcagggcactacagaaggactttacatgaattaccttatttcatcctcacagtcacccagcgaacacccattttacagatgagacggttgaggcttaaggaggttaaattactcacctgaattcttagagtggacagtaatgagctctaaaattcatactcattccttgctgctttctcattctccacagatacatctagtccccgtttaagggtggctgccatatgcagggtcaagattaagtgtaggttgagccaaaaaaaaatgtaaaaagcaaaaataaaacagggctgtcctttttctatcttcttgtcttggttaataataataatttagccaggcatggtggctcatgcctgtaattccagcactttgggaggatcacttgaggccacaagttcgagaccagcctgggcaacattgtgaggaacaccacccccacccccccgccaatatctacaaattttttttttttttttagaaattagccaggttgactgggcacagtggctcacacctggaatcccagcactttgggagaccgaagcgggcagatagagcgagctcaggagttttaagaccagcctgggcaacatggcgaaaccctgtctcaaaaaaaaaaaaaaattagcaggcatgatggtgcacacctgtagtcccagctacttaaaaggctgaggcaggaggatctgagcccaggaggtcaaggctgcagtgagctgtgatagcaccactgcactccagcctggacaacagagtgagaccttgtctcaaaaaaacagacaacaaaaagtttaaaaacaaacaatttataggctgggtgcagtggctcatgcctataatcctagcactttgggaggccaaggtggatgggtggatcacctgaggtcaggagttcgagacctgcctggccaaaatggggaaaccccgtctctactaaaaatacaaaacttagccgggcgtggtggcgggcatctataatcccagctactcgggaggctgaggcaggagaatcacttgaacccggggggcggaggttgcagtgagctgaaatcacgccactgcactccagcctggatgaaagagtgaaactccgtctcaaaaaaagaaaaaaaaaaattaaaaagcacttactatgtgccagacattattctaagtatttccatttttttaaagtcctttatcctcccaacaagcctgtgaagtagtctcttttattatcaccattttacattttattggcttcgttcttccggttcattgctacccaggtttaaagagtaagatttcccagaggatcaccagcaggatctttttgtagaaagaagacacttctatccaaggtctctgcaagatcccagcagatgcctgcatcatattaaattaagggccatcccaaatctaatagtcaaaagagccaggtgcagtggctcacacctgtaatcccagcactttgggaggccaaggcaggacgattgcctgaggctaggagttcaacaccagcctgggcaacaaagtgtgaccctgtctcaaaaaatatatgtatattataatagcagtagtaacaagagtctctgtttaatgaccacctatgacttaccaggtacttcactgtgtgtgaactctctcatctaatcgtatgagggaggtactattgcagtccccatttacagatggagaagctgaggtttggaattcactagtaagtggatgactaggtcaggttcccttgaagcggatacttaggtgggtgttcagatgcacctgctttattgggggacggctcttgggagagacagcaggagatcagcagggtggggctggggaatggatagagcagggacgcaatttcagctggagtgtgtgtgacaccagagttgtcctccaatgcatggcaaggatgccggccttttgtacttctatagtcagtcactgtggatgggaggtagagacgcagtagctcccaggtgagatagcttttgatcaccaagggcaattctactaagaagagaggcagctgggaggcattagcaaccaacatccatagcagctggagggcgggtacaccagaaagaaaatgggatcttggccagacaccaagagtatccagcaccttaaccactgcaccacactgcatctgttagcacccacattacattttttttttttttttttttttttgagacggagtctcgctctgtcgcccaggctggagtgcagtggcgagatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagcacccacattacatttttaagcccttggagtggcatggcccctcgagctatcctgacagcttccctctcttactgtggtctccacccatcaagagccatgggaagttcctgcaatcaagaagcaaagcctcaggctatatgtttgaaccttcattttgatcatagactttcctagtagataccatagtggttacaaacataggatgttgtcatcgttcagacctgagttaatagcctcaagaaaaaaatggtagtggaaccaggtatggtgaagtgtgcctgtagtcccacctactcgggaggctgaggcaggaggctcgcttgtgcccaggaggtcaaggctgcagtgagccgtgatcatgccactgtattccagcctgggtgacagagcaagcccatctcaaaaaaaaaaaaaagccaatgataggcagagaaatactaactaaggctcttgctctgtcgccaggctggagtgcagtggtgcaatcacagctcagtacagcctcaacctccccagactcaagcaatcctaccatctcagcctcccaaatagctgggactccaggcacacagcaccatgcccagttaatttttttgtattttgtagagacagggtttcaccacgctgctcaggctggtctcaaactcctgagttcaagtgatccacccgcctcagcctcccaaagtgctgggattacaggtgtgagccaccacgcttggccagctattattattattaacattcttcgagtcttacaacagtggaacttttagtgcaggatgcgaatttcagtattaaccccttcctctcccaaaaggatttgaagcccagagtaattcagccgccatgaatgaaccatttgttagatgagaggctactggaggctgagcttggtaggataagagcttgcatggggtccctgattgatgacaatacccccagatttaggtcttcagatgcccagttgggtgtgtcttctgttccactgtgtcccttcggggactgttccctgccttctttctttttgagatggaatctcgcactttcacccaggctggagtgcaatggcgtgatctcagctcactgcaagctccacctcccgggttcacaccattctcctgcctcagcctcccgagtagccaggactacaggtgcccgccaccacgcccagctaatttttttgtatttttagtagagacggggtttcaccatattagccaggatggtctcgatctcctgacctcgtgatctgcccgcctcggcctcccaaagtgctgggattacaggcgtgagccaccacacctggccccctgccttcttattcaccaccatctttctgaattgggttgctcagaacagagaaagcaacatcagcacatgggcaaacatggggcttcatttcagatggacctgggttcaaatcctagttctgcctttttttttttttttttttttttttgagacagagtcttgctctgtcacccagactggagtacagtggcgtcatcttggctcactgcaacctctgcctcccaagttcaagcaattctccttcctcagcctcccaagtagctgggattacaggcgctggccaccatgcccagataattttttgtatttttagtagagatggggtttcaccatgttggccagacttgtcttgaactcctgacctcgttaatccgctggcctcggcttcccaaagtgctgggattagaggcgtgaaccgccgccgcgccctgcctagttctgccatttctcatgcattctctgggtgaatcacagcatctctgttagccttgcttcccacttctgtaaaatgagagtgactttacatgtatggccacctcaggggcttgtcactagaagccagtgaaataatgttgagtctggttccttggggttgaaattgggaccgccaaccgctttcctacccagagcagcaactagcctatatggcggccttttatgaatgaggaaaagacaccgcctcttggcagaaaaaaaaaattaagaaaatggctccctcttctgggtgcaagttgcccaacacccaggaatatggctccaaaagcaatggactcccacccctttcttgcccaaaagatcatcaaatggaacagcatgtcaaatacctttattaagtactttaaagttggctgggctctgtggctcatgcctgtaatcccagaactttgggaggcagaggctggaagatcgcttgaggtcaggagttcgagaccagcctggataacatagtgagaccctgtctctataaaatatatatatagatttatttgagacagcgtcttgctctgccactcaggctggggcgcagtggcacaatcatagctcactgcagccttaacgatcctcctgcctcagtccctagagtagctaggactacaggcatgcaccatcatgcctggctaattaaaataaataaataaataaatactttaaagttaaaagtgctttttaaaaaataataaggccaggcgtggagactcacgtctgtaatcccagaactttggaagaccgaggcgggtggatcacgaggtcaggagatcgagaccatcctggctaacacggtgaaaccctgtctccactaaaaatatgaaaaattagctgggcctactcgggaggctgaggcaggagaatggcgtaaacctgggaggcggagcttgcagtgagccgagatggcaccactgcactccagcctgggcgatataacaagactctgtctcaaaaaaaataaataaaataaataataataataataggggccaggtatggtggctcacacctataatcctagcactttaggaggctgaggagtttgagtccttggagaccaggggtttcaggccagcctgggcaacatagcaagaccccatctctacaaacaagttttaaaacttagccaggcatggtggtgcatgcctgtagtcctagctattgcagggactgaggcaggaggatcacctgagcccaggaggttgaggctgcagtgagctgtgattgtgccactgcactccagcctgggcagcagtgcaaaaccctgtctcaaaggaaaaaaaaaacctaggaagtgttgttcccatgataaggatcagcctccgtgtggtgcttccttcaccattgcccaatccccaggctcctgggtgcttaatattccctcaggaacacacctgctttgtctgggagagacctgggcgtcttggtggcggggtttgggggtacttgctcatgggcttatggggcctctctctgtgtccccccaggtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacaggtaggtccacggagcatgatgcatctttccagttttctccttcagggacaagctcttgggaggattaggcaggggtgtgcttctttctcctggcagctgggaggaccgtctccttcagagagcactacaggagaggcagtgagtgaaatagcctctgagatcttagctgttgaaaggggtggggttccacagaaggtgacccagcagagaaagagtttatttgggaatgatcccaggaagcaccatcgggggaatgaggaagtgagcagagaaagaagggatcttttaaagagtgtgctatcaagcgggttaccacttaaaactgggactggatccccctgggcacctctgggagacagcaaagaacacacaactcagctggtcacggtggctcacgcctgtaatcccagcactttggggggccaaggcgggtggatcacctgagatcaggagtcagagaccatcctggccaacatggtgaaaccccatctgtactaaaaaatacaaaaattagctgggtgtggtggcaggcacctgtagtcccaattactcaggaggctgaggcaggagaatcacttgaacccgggaggcagaagttgcagtgagccaagatcacaccactgcactccagcctggcgaaagagtgagactccatctcaaataaataaataaataaaaatataaataaaaaaagaacacacacctcagagccgtcccagccaaggggcaagggagctggggtatttatacactggcttctttttgacattggtgaggactgctcctagagtgggaattaatgcctggcacatctggctgagtggaacaggtattctgggtgctttcagacctcgaccagtcctgacttctaaagcaagcaagaagtggggagagttgggccagaaaagggttattgcctcaatgcattgtgagtggtaccttgtggaaggtgagagacagagaagattccaggcacaggtgccatgctaaacgatagttctcatttattataggaacccatggatttattttgttctctgccctgagtgctgggtgagagtactggatgagtcctcctggtctcccccaacccccaggatgtaccagagataccccaattgggagtcctggcaccaaccaatcagaacctagcactcagcagcattctgcccctccctgactatgcccacattaacccttcagtggctgggtctgggggtagggtgagccccggaaaagccaggcagcgcagagacactctcccagggctcagctctgaaccagcagtgtggaagcagtgtgtccaccacgatccacactcaggaaccaaatagcccttggatacgttttcagttaaatctttgccatccaaactctagctgcttgctctctaaagctccagaatgaaatggaatcaagtaggaagggatgccttcagtatttcagtatttggaccactggccatctgggtgcagacagactgaatagcagttctggttctgatgatttgggtcaagggagctgtgaattgaaggagtggatagaaggaatcaagaagcccaaaggggaacccaggtgggcagagaaagaggtttcaggccccttatttgggaaaggcagccacagaagaagattctgtctgggagtggatttccacccaccctctccacccagtgacccccaagtggatccgcagaggcagcccctgagccctccctccccactcctccccacggggagggaaaacccactggggaaggtttatttgcaatggttggaggtttgggtttttttgtgggttttggtttgttggttttttttttcctctttttctcttgctcctcctgtctctttctctcctgggcttgtgaagtttgctcaatatggaatgtcctaattatttctttccccgatgaagaaggtgttaattgaggcagagctatttctgctcctggcctcgtcacccaggcggaaatgcgagagagagagagagagagagagagaatgaatatggggcagggcctcttggaaaaatcagccgtgagcagagaaaccaggactcctggatcctaggtttctgtgaagttttattttatgtttttctaccctagactagctaaaggagaagaggccatggggttggcttgggtccgagtggggttttgaggggacagatgtgggtggtgccaccagaggggaggaagcctcgatttaggagaaagactgaaaagctagctcacgattaaaaatataagacgtgtgagtaagagacagatatatacagacacccaggcagtgggttaattttaaaatgtatttataaccgaattcctcagacactctggacgcttgtttttctagaagcaacgctcagagtgtttcgtgtcggtggttggggggttgagggggattgcaaagctgctaaagatagacccgttttcagtagcattcctcagtgtcgggagcccagttcctgtgtgcccagcaccgtgccaatcgcttagaaggaagcaaagataaagtggaaggcttcctgctttctaagagcttccaaaatagttagaggaaacaagacccctcatttgcagccatttttaacagtgaaggctaatgtgtgattatacccacgcccccctaaatatgaaaattcagtagctattgtatgcctgaaaggggccaggtgcagtggctcacacctgtaatcccagcactttgagaggctgaggtgggagtatcccttgaggccgttagtttgagaccagcctaggcaacatagccagaccctgtctctgctaaaataaaaatttaaaaattggccgggtgcagtggctcacgcctgtaatcccagcactttgggaggccgaggcaggcggatcaaaaggtcaggagttcaagaccagcctggccaacatagtgaaaccccgtctctactaaaaatacaaaaaaaataaattagccgggcatggtggcgtgtgcctgtagtaccacatacttgagaggctgaggcaggagaatcacttgaacctgggacatagaggttacagtgagccgagatcacgctactgcactccagcttgggcaacagagtgagattttgtctcaaaataaaaaaatttaaaaattagccatgagtggtggtacatgcctatagtcctagctactcaggaggctgaggaagaaggatcacttgagcccaggaattggaggctgcaaggctgcagtaagctatgatggtgcccgcactccagcctgggtgacaaagtgagaccctgtctcaaaaaaaaaaaaaaaaagagagagaggaaggaaagaaggaaggaagggagggagggagggactggggctgtgttaactgggctacacaaagaggctacatggagggtgggaattgagccagacttggacatggcgtggagacagagaagattccaggcacaggtgccatgctaaacgatagttctcatttattataggaacccatggatttattttgttctctgccctgagccttatgtttaaaagatttttgccttccaacctgtatttatcaaataatagttcatgtaccaagtccagcataagtgaggaaggcgtttccaacaacttaagttcatggcgaggctagacttggagtttctattcagccagagcttgaaaggccaacaagattcattcattcagcattggtttatttccctctgctgtgtgctcagtcaagggagcagagaattggtgctgcgaagtctgtagcacatacattgagagatatttttgttgagtaggaagcttgagtttacacacactcagctgtttgttttcttgtccgacaatgccacggtcgtctttgaaaaccttcaaaagcatcgctcacagaataaggtcctctcagacccgctgtgctggtaaaatgaggacactcccagatgtgagctttcctgcctccctaccccatcaataccttaagatttggactgacctttagcgttcagcctgactgccacctccccaggaagctgtctttggtttccagcaaaaggggtgtctgttggcacgtttctctctccttgtggcattttcacagcctgcctcctgctatttggggagaaagctcagctcctgttccttacccttaggcaagggtaggaactgtgtgtactggtgtccctcacccccagaacagctccctgagcccagtacatcccaagaagaaaaaaatcagcaaggcttataggagaataacacaatgcgcttgacaaatttgtcctaatggatgtcggaagaaggctgcacttaccagctacaccatgcacacggcacatttactaaaactgactatattatggaccataaagtttgtctcaacagaggtcaaaaagctgaaaaaaatacaaatacaaaacatattttctgaccgtaatgcaattaagctggaaatcagtaacaaaaagagaactctaaaagtgtttgcagattaacagacatgcctctcatttatggatgaaatgatatgatgtctgagctttgctttaaaaatattctaggctgggtgcagtggctcacgcctgtaatcccagcactttggaggccgaggcgggcggatcacttgaggtcaggagttcgagaccagcctggccaacatggtgaaaccccatctccactaaaaatacaaagattatccaggtgtggtggtggccacctataatcccagctacttgggagcctgaggcaggagaatcccttgaacctgggagtcggagattgtagtgaggtgagatcatgccattgcactccagcctgggtgacagaatgagactccgtctcaaaaaaaaaaaaaaaaaaaaattctagtggcaaggcaaagtgtttggaggggatacagaggaatagatgaaacaaaatttgccagaagtaaataggtaagtgtctaaattggtgataggtacatggtgaatcattatattgttttatacttctctctcgctctctctctccccccgttctctccctgtcttcctctcccctctgtcttcatatatatatatatatatatacacacacacacacacagacacctaataagtttttttaaaaaacaaatacatctaaattacccataggtcaaagaagaaataataatggaaattagaaaatattttacttgaacaataatgataatgcatgacaaaatgttgagatgcaggtaaagccacacttaaaggcaatttatagccttaaaggcagttaatccatccatctcaaaagtttaggaaaagaatagaaaaaaaaaaaaaactcatggaaaacataaagagaaaagtagtaaagctcagagaagaaattaatcaatagaaaaccaataatagacccccaaagccaaacattgatctctttgaagactgatcacgtttgtcccaaaagttattcgttccaacagcattatagagtcactggtccctatttctcagagctggttttccctgctccttcccctgacttttctccccttcccttttgtagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatgtaagtgatgctgggacagtgtgtgtggacaatcagagtctcagggaggtggcctcctgggaccagtgagactccaaggctgcaatggagggaccctgagctgggaaaggcagcccaaggacaacacagccccactgaagctggcctgaggctcaggcttttgaagattacaggggctcatgagcagaactctaactatagggcatagaagtctggagggcccccagatgcaacatcatttttcattgtgcaagtgtttagatataattttagatttttgaatacggaaaggttatgtgatccaaaaaccaacacagataaaagatagagtaatatctttggacgtaggcgaggggtccctgccctgaggctcacccagtccttctccagccataccactccccgtgggatgagaagttcctggagccaaggggatgtgtctaccaagagcttgtgccccactttgtaggccatgttttaagttaccaggatcctggaattccctgcccatggccagattccatgaacttgcgtgcaattctcatatggatctgttcgtaacccaactgagggccaaggacatccgaggggtggctgttaacacaaatgtggccagagcttggatgtacaagctggaatgcccacacatatgtgtggagcccctctggcaggacagagccatgactaagaagagaaagggacaggacagggctggctctccccacaccttgacccagtgcagatatccggattctaaattccaccctgaccttccaaagtgtaaaggaaggtatatttgcaaagtagaagcacacagcatgttttatttagttaccttttcaatatttccccgtagtatgtggtctgcttttgtactcttgccctagatcttaaaaatgttagggatgtttctggaaagatgtatccctgcccccacttgcatgctacttcctcttcccacaatatgcaacccctttagttcctcagaatatccttccaatgtttatttatgcaattataattataagcataatcgaatctatgtcctcccccctctttcttatcccaaggagtagcattctatacatgctgttcaattctgtgatttttgttttctcataaccacacgttctagagatctttccactgcaggacatggacagtctcttcacgggtgcacactagtatgcccagctaatttttgtagagacagggttcttccgtgttgcccaggcaggtctggaactcctgggctcaagcaatcctcccgcctctgcctcccaaagtgctgggattacaggcgtgagccaccacgcctggccttctttattcttttgcacagctgcatagcattctattgtgtggctgcccatagttttatttgtttgccattaagagaaatgcttgactggcttcctgtccactgacatggaacatgatgctgctctgccaggagcatgttgcacgtacctcttcatacttttgcagatatagctagggggttggagggtctccattcccagaagtgggattgcaggatcaaagactaaatgcatttataattttatttttggggaagatttttgttttgtttttttggagacaaggtctccctctgtcgtccaggctggagcgcagtggtgtaatcatagctcactgcagccttaaactcctgggctcaggtgatcctcccaccccagcctcctgagtagctgggaccacaggcacacaccaccatacctagctaatttttaagaacaattttatagagatggggtctcactatgtttcccaggctgctctcagactcctggcctcaagcaatcctcctgcctcagcctcccaaagtgctaggattacaggtgtgagccactgcacccagcctaaatgcatttataattttgatagatatttaggtgtgcaagttttaaaccccactctgtcctcaccacagttcaccttccctcacctactatgcaggtaagcagtccccaggcaggtcacttgtcagcagctggagtggggcagagccaaggattcaggatcaaacacaaggatgccacaactgtagtgaccccatagagcaccctggggctgctccatacacacagctctgttgaccagtggaggtctcctcttcacctgccctaagggctgaaattaccattgaagtttaggccagcggttggcctgacccgggagcaatacctggcttcctcctcctgtacatagagaagctgaactttcctcttggtcctagtgtatgttccttaacaacccatttatgcctagtgttccattattggaatgctaatcctgtgggagttatttacatcctgctgctcaaggtcatcactaaggtcggatttttcacacacacaaaaattgcaacctccggcataaatgggttaaggaatttccccacttgtgggtggagggagatttgcaaaaactcatccttgtaatcctgatcaacaaaggcccgttttagttgggagtaggcagcaaaaggagccacatgaacagttgcgcctgtcacgcactgcacaagaatgtcattcatatcatagacaacatacgatttctactgttatcctgataatttattgacagaaaaaaggatgtggggaagggacatggtgttctaatttgcatgaaaacctcgtctgagtgtagcatctctgggaacatgcagcagatccgagctcaggccctctcttggccgtcacctgcaaacagcttggacaaagggtcagcccaattggccaaaactcactggggaatttttgtgggttctaggtttttactttgcaaggctggtgtgagaggaggttccagcaggaaatgaaccctcctgagagggaaagagactgggaaatggagaaggctgggaactcagggagagaatgggagtggggaatgggagctgaaaaaaattgtgagcataaaaaagggatatgtcacagggttggatgaccagagaaagcgtctgggggttcagattaagatgctgggggcgtgcccagtggtgggacaggaagcatgaatttccagagggctcggttataaacatcattgtccaatgggtgtttcccttggaagcctctaagcttagagctaagccacctctggggacacaaactgagtggttaagagcagagactcaggtgtcagcctgtctgggttccttccgactcttccacttccttgctgtgcagccttcggcaaggtgcttggcctctctgtgccactatttccacatgtgcaaaacgaagagaagcatagtcccacctcacaaggcacgaggactaagtaaggtggattcgcatgaagtgtttagaactgatcctggcccggggtgacctccgtgtaagtcaaattccccaccctgcatggtgttccttttagaaatgtgcatgaatttttcattagaacagctccagcagtgcctgaggaagtggagtgaggtgtgagaggtcttactttattcccctcgctggccctgctattaaccactaactcagagtagctttctagcactttccacacatttacatcccaccctcgtcctttggttagcagcccatgcaatgatttggccttaatgtgaacctagaacacagcttctcgcccagggatgatttctgcccccaggggacacttggcagtggctgcagacatttttggttgtcacaactggatgggaagaaggaggatgctattggcatcaagtgggtaaaggccacggatgctactcaacattctacaatgcacagcatcccccacctctgccccaccatagagaatgatccaggcccaaatgtcagtaaggtttctgtcaggaaaccctgggtcagaagaccaaggttccttgaggacggggatgccttatactgcaatcagctgtcactctctgcctctctctggggctgctgtgatcacctggcctgcatggacaacccctaggagcagcccccatccagtgcctggagaagtcagtggataaataccccagctccctccctgtcgggcgttttgctctgccctgcatctctccagtgggatcaggctctggttgcccgcagggttaacctggtcacgtacacacccttcacttgccaccttcccttccctgtctggtatttcctgggatgaacttttagatttatttcctggggctgctataatgaagcaccacagactgagtagcttaaaacaacaggaatttatggtctgacagttctggaagccagaagtccaaccccaagatgttagcagagctgacaacacgcccctcaaaagcctccgggggaggatccttctttgcttcttcctggcttttgctggtttcccacaatctttgggattccttggcttctagagccttcattctccattccagtcttctgtcatctaatagcatcctcccagcccgggcacagtggctcacgcctgtaatcccagcactttgggaggccgaggcaggcagatcacttgaggtcaggagtttgagaccagcctggccaacatggtgaaaccccatctctactaaagatacaaaaattagccaggcgtggtgggcgggtgcctgtaatcccagccacttgggaggctgaggcaggagaatcacttgaacccgggagatggaggttgcagtgagccaagatcatgccactgcactccagcctgggtgacagaatgagactccgtctcaaaaaaaaaaaaaaaaaaaaaaagaaaaagaaaagcatcctcccttcgtgtgtctgtgtgtgttctcctcttcttagaaggacatcagttgtattggatcagaacctaccctactccagtccaacctaattttaactaattacgtctgcaattaccctatttccaaataagatcacattctgaggtaccagggggttaggacttaaacatttttgtgtgtgtagcaggaggacgtaattccatttataactcctcctaaataaaacgacttgcatgtgaactcttgtctggggcttcccaaagtgagataacccctctctctacccctaaaacaacgagtagcgtctgtcaatgccagggtgcaggggctaaggtgcccatctttgagtttctgctgaggaggacacagctgctacgttggagcactcttgggttctgccttcgtgcccagccatctcccttgggctagccctgccctgggtctatcctagaatgagcctcgatctgtttggccataggcaagcagagtgtctggaaatctttgtcctccatgactggtgctggagccgaagccagtgggtgtggccttgccagccaactccatttacccagctctgaacaagctagtagttgagatcaacggagagtccagacagtcgctccaagcatcttggaatccatggacacaggtgtaccgcagaggcttcccacctgggtaggcagccctttgtaagatcctggcaccacatttattctcttaacatcctttcagttatccagtaatcatttattgagcacctactgtgtgccaggcaatgattaggtgattggagacactgcaacgaagaagacagactaaaatctccaccctggtaggagagacagatgcaaatggtaaacatgataaataatcaatcacccagaaagcaggagacactaagcaaatgtgtatgtactatgggaagcccaataggaacgaaagctacacaagagaacaagtgatgggtggttccttagtctaggtcaggcaatcagggagggcttctcagaggaggtgatgtttgagcagagaaggagggagccaggcagatgttttggaaacagcattctcagcatggagaacagtggcagctcacctacaggatgtgtttgattcccttccagattttgtattcgtttcttgtttttctcccttggcttcctggtttaaatgccttttgaagaaatctaagctcaactaatcagcgatgctgttgaaggtttatatcaggatatgcatcccagagttatttacaaaattagaacaaaactggaagcaattgaaagcctgacaataggagatcagttaaataccgtatggtccttccgtatgatggcatattatgtcatcattaaaaatcgtctgctgggagaatattaaggatacaggggaaaggctcaccatataatgatgagtgggggtgctgggcgcagtggttcatgcctgtaattccagcaatttgggagtctgagatgggtggatcacttgagcccaagagtttgaggccagcctgggcaacacagtgaaacccaatctctacaaaaaaaaaaaaacaaaaatacaaaaatcagccaggcatagtggcgtacatctgtagtcccagctactcaggaggctgagacaggaggataggatcacttgagccctggagtcagaggtggcaataagccgtgatcacgccactgcactccagcctgggcaacagagtgaaaccctgtcaaaaaacaaaacaaaaaaaatgatgagtgggagaaacaagtttttaaacagggatcaaggaggccaggcatggtggctcacacctataatcccagcactttgggaggccaaggcaggcagatcacctgaggtcaggagtttgagaccagcctggccaacatggcgaaacctcatctctactaaaaatacaaaaattagccaggcatggtggcgggcgcctgtaatcccagctacttgggaggctgaggcaggaaaatcgattgagcccaggaggtggaggttgcagtgagctgtgatcatgccactgcactccagcctgggcaacagagcgaaagctgcacgagagaagaagtgatgcatggttccctagtctaggtcagccaatcagggagggttcctaagaggaggtgatgtttgagcagagaaggaggaagccaggcagatgttttggaaacagcattcccagcatggagaacagtggcagctcaccctgtctagaaaagaagaaatgataagaggggaaaatgagtttttaaaaaggaatcaaggggaggtaaaccttatgatctcaaaggtacaaatatgaaaatataagtaaagaaaaactggaggacactgtaccaagctgaccttcgggtggtgggatttgggaatcttgatattctcaatacttctttgtatcttcaaatttctctatgatgatcacagtttactttttttttttttttttgagatggagtctcactctgttgcccaggctggagtgcagtggtgcgatcttggctcacttggctcacctctggggttcaagcaattctcctacctcttcctcccaagtagctgggactataggcatgcaccagcatggtcagctaattttttgtatttttagtaaaaatggggtttcatcatgttggccaggctggtctcgaactcgtaagttcaagtgatccaccaacctcagcctcccaaattggcttgagccaattaaacttgtcttgctaaatggttagcggggagaaagaagaaggtctcgggtcattcctagaccaggaggcagggagaaagggaggagaatgaacctttcttaggcaaacagtgtcctaggtgtccttatcttacataatctgtcgagagagtcacactaaaataaatcattgattgattgattgatacatcaataataaatggccagccttggtggctcacatctgtaatcccagctacttaggaagctgaggtgggaggattgtttgagacaaggagttcaagaccagcctgggaaacacagcaagactcatcttaaaaaaatttttttttttaattagccagatgcggtggctcacgcctgtaatcccagcactttgggaggccgaggcgggtggatcacgaggtcaggaattcgagaccagcctggccaacagggtgaaaccccgtctctactaaaaatacaaaaattagccaggcgtggtggcacacgcctgtagtcccagctacgcaggaggctgaggcagaagaatcatatgaacctgggaaacagaggttgcagtgagctgagatcacgccattacactccagcctgggcaacaagagcaaaactacatctcaaaaaaaatgttttttaattagccgggtgtggtggtccatgtctgtagttccagctacttgggaggctgaggcaggaggattgcttgagcccagcagttcaaggctgcagtgagctatgatcccgccactgcactccagcctgggcaacagcaagaccccatctcttaaataaacacataagtaaataaatgatcatttttattttattattaaatacacaagataaatgaaaaacaggcaaatctttcttacaaaagaattccatttaaagtatgtaaacttcactccccactgccccaggaggtggagactaatctcccctactttgagagtgggctggatttagtgactcatttccgaagaatagagtaggtaaaggggaaaatagaagttttatagcggaggaacagatagataccactttaaccaaatgatgaagattagtatcccccagggatgtggatattatgtaacccttgattttatgcctatatagcgttcttcccaaaaactcctaatcccagttttttggggttttgctctgtcttctaagctggagtgcgatgatgcaatcatagctcactgcagctcaaactcctggtctcaagcgatcctcccacctcaacctcctgaatagctagggctgtaagcacataccatcatgcccagctaattgtatttttttggtagagacatgttctcacacattgcccacgctgtcctcgagctactggcctctagtgatcctcccaccccagcctccagagtcactgggattataggcatgagccactgtgaccagcccagaatttttttttaaggagttgtgatgtcgtttaagagatgtgattcttcataacacatcaacaacaagtcccagcgatgggttggataagtcttgggatttcatgggagtattaagcttaaaagactttgcatgatatctgtgaactatatgtgatttctgttggtaatgggggtcactgattctgcggtttgccacctccaatcatcatggaagaaaatgttccacttccagtgaaagtaagaggaagtaaaggggtaattattttctatctaaattcacgaactccttgaattctgtccacagacccctaagtgtttcctccccaaggtgaaactgagagaatcttgccagtgccttccgcagtcactgtggctagaaaacccctcagaagaggtgatagtttagcaggtaactggagttctcaccatccgtgtctggctcagcccccatcacaaccagttacccagcccaaaatgtcagtagtactgaggttgagaggctctgctctaggaggccaggcctctcagaggaaggaggattggggtactggctgggcctcaagatgaacctaccccctaagagctttgggatggcgtgagtttctgtccatacccaaggactacaaatgcaggtttactggaaattctgtgccaaaagtgaggtccaactcacttctaactgctacaaaacaaacctccatcaacatagcccatctctgttcttgacctggaagctccaaggtatccacatggctcccatgcccactagacgggcctcttccctggaccttcctgggccagagaaggctctgggtagccttgtggaatcaagatgggtgatcagccacttcctctgtgccaccctgttttggctacttccctaggcatcagcctgggattccttgatggtaaaaatataaaactctctgagctagggcctttaatatccccattttacagatgaagaaactgagtcccagagctgtgcacagcgattgagagtcagaattcagctctgtctcactcagtgtcaacatcctcagattctgccatttatagcctcccacagcaaataggattgagggctgcttctctgagctcaaggggatagaatggggaaccccatgagtactgcaacaaaactgtttgctggagacaagagctggtggctctgtgttgttctagtgacaggtggcctcatttcacagggaccccctcaccctatgtgccccatgtggctcagaaaagccagaaattgtctccactctcacaggggaaggtccctgaccccctctttgccagctgggccaaggcaaattggggtcacttcatggggtacaggacctaccctctcttggttgcccccaaggaggggatgtggaggggctggggacctggcaggaccagggtgtcttgagttaatttggggctgcctttagccgagggcttctgtgtgcctggcatcagctttacattgtgtcttgatccgtaaaacagccctgtgaggaaagatatttttaaccccatcttccagatgaggaaacggaggcccacagggtgacgtgacctgccaaggtcccctagccaagagtgacaaagccagggttcacacacagctctggacacaattcatcacccttcatccgtctctctctgactctttctttttccctctctctctttgtctctctttttttttttttttttttttgagacagcgtctcactctgtcacccaggctagagtgcagtggcgcaatctcggctcactacaacctccatctcctgggttcaagcgattcttgtgcctcaacctcccaagtagctgggattacaggtgcgtgccaccacacccagctaattttggggggttttgttttgttttgagatggagtcttgctctgtcgccaggctggagtacagtggcgtgatctcggctcactgcagcctctgactcccaggttcaagtgattcccctgcctcagcctcctgagtagctgggactacaggcatgcaccaacacgcccagctaattttttgtattttagtaaagacggggtttcaccatgttggccaggatggtctcgatctcctgagctcatgattcgcccgccttggcctcccaaagtgccgggattacaggcgtgagccactgtgcctgccaattttttgtatttttaacagagactgggtttcaacatgttggccgggctggtctcgagctcctgacctcaagtgatctgcctgccttggcctcccaaagtgctggtattacaggcatgagccaccatgcccagcctttgtctcttttattcttgtgttctctctctctcttccttctctttctccacctccttctccttctctcccttctcctcacccttctttgtgcttttctctgtgagtttctcttcttctctatttctctcctttggtgaatgtcaattagaaaagcagaaaaactgcgtttaatttgtgatcataaatgcatgtccctggccaggcgtggtggctcacgcctggaatcccagccctttgagaagctgaggcaggaagattgcttgagaccgggagttcaaaaccagcctggtcaaaaagcaagaccccatctttaaaaaagaaaaataattaattagctgggcatggtggtgtgtacctgtagtcccagctactcgggaggctgaggaaggaggattgcctgagcccaagggtttgaagctgcaccgagctgtgattacacccctgcactccagcctgggtgacagaaccagaccctgtctcaaaaaaaacctaataattaaaaataaataaataaataaatgcgtgtcccctggccagtggttgctaatgtttggaatcacctttgacccatgccctttttcattcatagatgtttgtcttgaccaaaatcaaagcattagactttggactataaatcactggttcattcaacaaccatcattgaatgcctactgtatgcagacactcttctggacacagaggagttgacgtgttggtggggaaagccagtgatcagttgggataaaaagggcagacagcagacattaaatagtttaggctttgtgggccagatggtctccatcgcaacgactcaatctgctcctgtagcgtgaaagtaacgacagataaagcgcgtaagtgaatgagcatggctgtgggccaattaaacgttaacctataaaaacaggtggctggcccgcgggctgtagtttgtggatcactgccttagagatagtgttagagggtggtgagaggtccgggatagaataaaacagtagagagtttgtgcattgtcaagatgagaggttgcagttcttcttatacaccccgaatggccgggcaccgtggccattatgatctataattctaacactttgggaggctgaggcaggaggatcccttgagccctagagtttaagaccagcctaggcacatagtgagaccccatctctacaaaaaaaaaaatttaaaaattagctggacatggtggagcatgcctgtaggcccagctacttgagaggctgagatgggaggactgcttgagcctgggaggttggggctgcagtgagccgatcatgccactgcactccagcccggatgacagagcaagaactgtctcaaaaaaaaaaaacaaaaaaacaaaaaaaacagacctgaaggaacaaatcatatgaatgcattaaagtatcacatgtatccaaaaaatatatacatctatcagcctggcacggtggctcatgcctgtaatcctagcacattgggaggccaaggcaggcagattgcctgagctcaggagtgcaagaccaccctaggctacatggtgaaaccccgtctctactaaaatacaaaaaattagctgggcatggtggcaggcgcctgtagtcccagctacttgggaggctgaggcacaagaattgcttgaacccaggagacagaggttacagttagccgagatcgtgccactgcactccagcctggacaacagagcaagactctgtctcaaaaaaaaaaaaaaaaaaaaaaaaaaaaaaatatatatatatatatatatatatatatatatatatatatatatatatataatcaattaaaaattttccttaataaataaacatttctctccttctctcccttggtgaatgtcaattaataaagcaacaaaactatgtttagttagtgatcattaatgtatgtccctggctgggtgtgatggctcacacttgtaatcccagcactttgggaggctgaggcaggagaggatagtttgaggccagcaattgcttgaggctttttgaaagacatgaaggagatgaagggagccatggagatatctcagggaacagcagccgaggtagatggaacagccagtgcaaaggtcctgaggcaggatgttcctggcatttgtgaggacatgtagctgcccagatgtccagtggggagtgagtgaggatgaaggaaggagctgatgaaggaagatgataaaatacttcatggatcagccaggcatggtggctcccgcctgtaatcccagcactttgggaggccaaggcgggtggatcacaaggtcaagagttccagaccagcctggccaacatggcgaaaccccgtctctactaaaaaatacaaaaaagttagccaggcgtggtcatgcacgcgtgtactctcagctacttgggagactgagactcgagaatcgcttgaacccaggagatggaggttgcagtgagttgagatcaccccactgcactccagcctaggtgacagagcgagactctgtctcaaaaaaaaaaaaaaaaaaaaaaagacttcgtgaacagacagcctatataatttatgatccaaaccaggacagttttgagagtgaaaggggaaaaagagcactgaaaaaataattagcaggcctggcatgatctataacgggtataaagtgggacacacagcctctctcacggtcactgtcagacttcagctttttcacactcaaatccacccccatgtttatcccatatactggagaaacgggtgttctcctgagctgagttttggggttttttccttttgttttgttttgtttttgtttttttaacatcctgtatactttttctcaatgaaccatgctcaaaaaaattagaggaaaataaaccataaaacagaaggcactgaaggattttgctgggactcagccattagtttgtttgatgagtatttatggagcgctttctaagcaccaggcaccaccagcgatactgggatgaatcagtaacatccctcacccttgaagctctcttgggcccattgttatttacttaaaatactatgcaagtacggagaaggggtgaagtgggaaaaaatcagttggttgtaaaggccagaatgacgggtctagtcccacccatgccatctgcaccctgtgtgatccaggcacatcatgttgcctctctcagcttcagtttctccatccaccaggcacagagatggcgggaatcgaggaagatgtggggagtatttcatcagcccaaaaagacttggctaatgcgaccataattctgccttctgcctctcctttcccagaaaaatagcttaatcatttggatttgggataaacacatttcctgtgtttattatttaaatgatccaccaagctgggcatggtggctcacccctgtaatcccaactctttgggaggctgaggagggcggattgcttgagcccaggagttcaagaccagcctggccaacatggcgaaaccccatctttactaaaaaaatacaaaaaaattagctgagcgtggtggtgcgtgcctgtaatcccagctacttgggaggccgaggcacaagaatcacttgaacctgggaggcagaggttgcagtgagcctagatcgtgccatcacactccagtctgggcgacagagtgagattctgtccctaaataaataaataaataaataaataaataaataaaataaatgatccaccaacaggaaccccaggaacatttgtattgactatgcaactaatgcttagtgagcacctactatgtccctggtgctgatctggacactgggatttagacaggaaaaatctctaccctggaggagctgatgatcaagatgacaatcttgaaatgcataagttgacaagatgattcagacagtggaacgtgctgggaagagaatgagatgtctggctgagctgcaggaaggggcaagtccttttgattgagaggtccaagaaggcttctctgatgggggcacaatggatctaaggttgagtgataagaagaaattggccaagccaagacctaaaggcagagttgctccaggcataggttcagagaatggaaataattggctgattgtgatcttgaacttgacctttcttttcttctgctaactttgggtttggtttgttcttgcttttctggctccttgaggtacgtgttgggttcttaatttgtaattttttttttttttttttgcttttttgagacagagtctcactgtggtgcccaggctggagtacagcagcatgatcttgactcactgcaacctctgcctcctaggctcaagtgaacctcccacttcagcatccccagtagctgggactactggtgcacagcaccacacccagctaatttttttatttttattttttagagatggggtctcactgtgttgcccaggctggtctcaaacccctagctcaagcgatcctcctgccttagccccccaaagtgctgggatgagaggcgtgagccaccacatctggcctctgttttttgtgatgtaggtatttgatgctataaacttccctcttagttgcttcttggccctttagctaaggtcaagtgtaaacttccctcagcactgcttctgctgcatctcacaggtgttggtgtgttgtgtctctattttcattcatttccaaaattttttaagtctccatcttaatttctgcattgacccaatggttgttcaggagcatgttgcgtaatatccatatatttgcatcatttctgaaattcttcttggtattgatttctagttttatcccacggtagtctgagaagatgcttgacagaattccagtattttaaaatttgttgagagttgttttgtggcctaacatgtggtctgtcttggagaatgtccatgtgctgatgagaagaatgtatgttctccatcagacatgcaagagacagacactttctcacctgcctcatgggatccataaaagagtcaatcagaagttggcatttaagaaagaccagaaggaggctgggtgcagtggctcatgcctgtaatcccagcactttgggaggctgaagtgggtggatcacctgaggtcaggagttcaagaccagcctgaccaacaaggtgaaatcttgtctctattttaaaaaatacaaaaattagctaggtgtggtggcgggcacctgtaatcccagctactctggaggctgaggcagagaatcacttggacccaggaggtggaggttgcagtgagctgagatcacaccattgcactccagcctgggcaacagagcaagaccccatctcaaaaaaaaaaagaaagaaaaaaaagaaagaaagaccagaaagaggtgaaggagcaagctacagagatatcaaactgtatcaatctggctgggcgtggtggctcatgcctgaaatcccagcactttgggaggctgaagcaggaggatcacttgagcccaggagttcgagaccagcctgggcaacagagaccccctctctacaaaatataaaaatttaattaaaaagatgtattggtcagggcagccaagttatgctgcagtaacaaacatccccaaagcctccatgacttttgacaacagatgtatttcctgctcatgctacatgtccagtgcaggttggcagtggggaagaagggggctctgttcagtgcagtcacttgagacctagctaatcacctagaacattgccacttgctattccagaaggaaaaaaggaatgctagaaggtcccacactgaaagttcaatgctctggctccaaaatgacagctatttccactcactcctcattggccagcacttagcatgtggtcctcagccaaccccaaagggactcaggaaggaccatcccaccatattgctggaaatatttgatggcagcattaatggggaacagtgttccaggcagtggaagtctttgagcccttggaagaaagacaaggcgatctctagagcacatccttcccaatattaatgaatttaacaaatgagcaagccatcctcccccactctccttcccgaattcagacttgtgcatatccctcccttaacttgaactgccaaagaagagatgagaaccaggagaagagatctgtgaccccatctttgctgatgaactaccacagaacagccatggcatctccagtccttgtgcttgtaaaatgtacttttcattttgctcctgaacgaaatccacccacccccacccccaaaccagggaaagctcatctcctaatccaaaactgcacccagccttccaccaccttcttccctgggaattgttgattccagagtatggaattgaataattggatgagtttggaagagaaaaagtgtctctaaaatcaggcagcagaagcccactccccagagaggatggtgcagatgagagttcaggagggagcttggcttggggttgacgatctgagctatgcagggaacttggacacacctctcaatcagtcattcaacagacaccacttattgagcaccgactgtgtgccagatgttgtcctagggggctgggaatacaggaatacagcagggaacaaaaaggacaaagcccctccctcttgtcgaatggacattccagccaggaagacgagagaacaagagaaataagtaaagtatataggcggtgaaatgcaaatgggaaaaaagaaacaatggggaccagaaatgaggggtgcaattgtaaagggccatcaggggaggcctccctcagaaggtggcatttgagtaaaaaacctgaaggaggtgaggggaaaccatgtagcaatctcaggaaagagcattccaggcagggagggacagcctgtgcaagggccgaggtaggactgtgcttggcgtggttgagaaactgcaaggaagccaggtggctggaaccgaatgagcgagggaaaaggggaggagataaaagcaaggagatgggagggttggaggccccctctgccattcagtaactgagtaacttcatttatttcctgtagcttgaaccacaaagaaccacaaatagagtagctgaaaacaacagaaatttatttattctctcgcagttcaggaggccaggagtccacagaccatcaaggtcagctgggccacagaccatcaagatgtcagctgggccatggtgcctcctgagacttggtctgaaatcccttcttgcctccctcctagcttctggtggtttgccaacagtgcttggtggtccttgtcttgtagacgtatcaccctgatcccgccttcatctccatttcacatggccttctccctctgtgcaaggttgtctctgtgcccaggtttctccttttcttattatttacttatttgtttgtttgtttctttattttagacacagggtcttgctctgtctcccaggctggagtgcagtggtgcgatcatagctcactacagcctcaaactcctggcctcaagcaatcctcctacctcagcctcctgagtagctgggactgcagatgtgagccactgtgctctgcccagatgtcctctttttataaggaaacccgtcatttaggatgaggttccaccctaatgacctgatcttaacttgattccatctgcaaagaccctatttccaattcataggtaccagggattaggacttcttcaatgcatctttttggagagacccactgcaacccacaacagaactgtgggcatgtaacttgacctctcggccaggcgtgatggctcacacctgtaatcccagcactttgggaggccgaggtgagtggatcgcctgaggtcgggagttcgagaccagcctggccaacatggtcaaaccccgcctctactaaaaatagaaaaattagctgggcatggtagcaagcacctgtaatcccaactacttgggagggtgaggcaggagaattgcttgaacccaggatgtagaggttgcagtgagccaagatagtgccattgcactccagcctgggtgacagagtgagactccatctcaaaaaaaaaaaaaaaaaaaatagacctctctgtgcctcagctttctcacccgggaggatggggataattatatacccactcctggggttcatgagaggattaaatgagctcaaacagtccaagcctccacgtgtgtctgttgtggtgctgggtagcatgtcctgtggccagaggttcccaagcttgtcgaggacccaggcaagggcagattcgggtcttgttggcagcacctgagatggacgggctgccttggtatggaagggcctcggctgtttttccctttcagtcctgtccctctcccccatcctccaccctgtccctgtcatctgagcctgctcctcgtgatggctcagagtctccctactggcggccggtgcagagtttcgttccctgggctatatttagccctgagaaatgggaacgagaaccctcagccgccaaagtgatggagagaggagcacaaagccagtgctgccttctgtccagcaatgttccgctgactcggttctttcttccagaaccttccagaagcaaagcattggcatttctgagctcgttaaaacaaggatgtgggctggtggctggcacattcattgtccccagaacctgtctgtgtccatgattaaagctgactttgttagttttattttcagtgcttttttttttttttaatccatggcaaaacacacatgacataaaatttaccatcctaatattttttttaactttgtaacattttttaattgacaagtaattgtacttattcatggggtacatagtgacgtttcaatgcatataatgcgtagtgctcagatcagggtaattagcatatccatcttctcagacctttattgtttctttctgttaggaacattcaagctcctccttctagctatttgaaaccattaatatattgttgtcatcctaaccatttttaaggatacagtttcgtgaaattaagtataatacattcacattgttgtgcaactgtcaccaccatccatctcccaaacttttccatcttccaaatgtaactctgtccccactaaacgcgaactccctgttccccctcccccagcccttggcacccaccatgctactttctgtttttataaatctgacgactctagggacctcctataaatggaatcatacaggattttcccttttatgactggtttatttcacatagcataatgccctcaaggttcacccatgttgcagcacgtatcagcattttctttctttttaaggtaaagttgactattaaaaaaaaacttctgccgggctcagtggctcacgcctgtaattacagcactttgggaggccaaggcaggcagatcaggaggtgaggagttcaagaccagcctgaccaacatggtgaaaccccatctctactaaaaatacaaaaattagccaggcatggtggcgggcgcctgtaatcccaactactcaggaggctgaggcaagagaattgcttgaacccgggaggcagaggttgcagtgagctgagatcatgccactgcactccagcctcggcaacagagtaagactccgtctcaaaaaaaaacaactttttaagaattgaagtagaataaacatacagaaaaatccgcggattataagtgaagagcttgattaattgtcacaaactaaacacatccatgtaaccagcacacaaatgaggaaacagaaacttctcagccccagaagcccccctcatatcctgttcctagtcactacctccccgcaagggtacccctaccaggactttgagcatcattcaccagtttagcctgttttgtattttgcataaatgaagtctggcttcttttgcttgacgttaactttttaagatctcatgtgacctgtggcattgttcattgcatgtatcctctctctcctattgataacagtgtggattgtttgcaatttggagctatgatgaataccattgctatgaatgttcttgtgtgtgctttctgttgtgtaattattcagaattactatttcggaattactatctaattgtagtgatcttggatcagtaactatccaagaattactgggtgttggcaaaggtacatacagttatacactgcacaatggcattttggtcaacaacagatcaaatatgtaacagtggtcccataatggaccgaatacataacagtgattatcatacagtatttttactatagcttttctgtttttagattcttttttttttgagacgaagtctcgctctgttgcccaggctggagtgcagtggtgtgatctccgctcactgcaagctccgccttctgggttcacgccattctcctgcctcagcctcccaggtagctacaggcgcccgtcaccaggcccggctaattttttttgtatttttagtagagacggggtttcaccatgttagccaggatggcctcgatctcctgacctcatgatctgcccgcctcggcctcccaaagtgctgggattgcaggcgtgagccaccgcacccggcctgtttttagatatttttagatacactatagagttacaattgcctacagtattccatagaataacatgctgtatgggtttgtagcctaggagcaataggcgagaccatgcagcctaggtgtgtagtaggctataccatctaggtttgtgtaagtacactccatgatgtttgcacaacaaaatgacctagtgacacatttttcagaatgtatgcccattgttaagcatgacttaattttagcatagaaactctcaaccaatttttcaagtagttgtaccatgtgttatgggttttattgtctcaccccaaaattcatatgttgaagtcctaacccccagtacctcagaatgtgaccttatttggaaatagattcattgcacatgtaaaggttttgccattggcaaaactgccgttatttttgcaccaaccatagcagttaagatgagatcattagggtgggtcctaatctaatacgatggtgtccatataaaaaggggagattttggcacagagacaggcacactcacaggaagaatgccatgtttaaacaaaggcagagctcaggatgatgcctctacaagccaagaatcagcaaagattgccagcaaaccgccagaagctaggagagaggcataaaacagattctgtctcacagctctcagaaggaaccagcccttctgacaccttgagcttggatttttggcctctataactgtaagacaataaatctttgttgtttaagccacctaggttgtggttccttgttacagcagccacaggagatgaatacagcatggtgccctcccattggcagattatgagggttccagttgctccacagcttcacagacacctggtagtaatgacctcatcttaacttctttctcattttagcctttcttccaggcagcagcagtgtcatacatgcttttaaaggtgggcttttaaagccacacttgagagccctgcattctgcaggtgtcacagggtgatcaactattcaaaggctacccctgccctgacagctggaggcaaggcttcccagcacagaggttaagcccatggactctggggccaggtggttagtgcaaatcccatgtccactagtgaataactctgtgatcttgggctgatgattttgtctttctaagcctcagtttcctcaatagtaacatgggcattataacatagaggcatcatgaggattaaatgactaagtgagctaacatacataatgtgcttaggaaggtgccagcacaccataaatactctgtaagtgctggcttttatcattcttttctctctctctctctctctctctctctctctctctctctctctctccctctctctctctgtctctctttctctctccaccccccaacctcctctccttgattttcttcccctcatcttacttccttcttgctatagtgttctattttctgtttcagagagtattctatttgtggacttttttcctcttgaaaattgagctgaaacttctgagaattttttgtgattggcattaaggctgcagggaatggagcagggagacacttgaggaaagggctcatggaccatctgtctggcttggtgatttcaccaggccatcagactctgtggtcatgcatctcctctaaggggagtctatgactgtgttgggagaagagaaggaaccagggattaattaatccatttcaataggttttgtgttttgtttggtttactttttccttctccttctggactgtggtctgggaagtcctcttgtgtttcttactccattcccaggtcaattatgttatgtgaggagaacataattaagagagagctttaccctttggatgttttcttcagaaaacgttcctccatttccccctctgggatgccagagccccagaactccacaagccaagaacatttaagacagagccacaagagaaccgagcttccccttccctcacctgtcaggttctatctgagtcccagtcaactctcacctgctttccctcctcacaccctacagagcaacgatgcctcagggaacacttggaactggttgtacttcatccccctcatcatcatcggctccttttttatgctgaaccttgtgctgggtgtgctgtcagggtaagtttctgctactccccaccccatcccactcactcctctttgctaacttctttccaagtagaggccattgaagctttgttttcattcactagacagagaaaaggcttcttcccttgtttgggttaccagactgttattagcaagccatgcacaggtgcagaggttgtgtactgctaggggtacccagtgagagggttcatatgggctttactttctttacattttttttaaaaaccaatagtttgggtttacttctcccccattttccaaatataaaatcatagcatatgctctaacggtgtattttcctgacccatattgtcctctatccccaagatttttttggcttaatcataaatgggcttcatttttcttaccataagaagtctgggcacttgtatggtggctctatggcaccatcagcaaccccagattcttccagctttccattctgacatctttaccagaggcttccaatctcgtggatacctcatggtcttaagatggctgcctcacgccctccggatggccacttcatgttccaaacaggaaaaggaagaagggaaacaggaagaggtgggacctatggcagagaagccaacctgctgcagaaatctttcattcatggcttattggtctaacttaaaagagggctgaaataattattagccaaaagtatgaagagaatgagaatgaggtatgcagccagtggtggttggcatggcatggttttatcctttcggtttttttcttttttattgtttttttttgagacggtgtctagctttattacccagactggagtgtagggggcgatcatagctcactgtaacctagaactcctaggcacaagcgatcctcctgcctcagcctcctgagtagctaaggcaacaagtgtatgccaccatgcccagctacattttttatttttcatagagatggggcccactgtgttgtccaggctggtctcaaattcctggccttaaatgatactcccatctcagcctcacaaagtgctgggattacagacatgagccactgtgcctggcctttttctttacctaggcacagttgtcgggaaatgtgtgaagctggcagaagcacccatcactataatatcccagtcttttcccagaagtcctgactcctcctgttgaaaactcctgacctccagggacttctgaatccccaaacacacacacacacacaaacacacacacacacacacacacacacacacaaacacacacacaaacgtttcctaacattttcaaaacagccatactctggcttttctatgcttctccagggagtttgccaaagaaagggaacgggtggagaaccggcgggcttttctgaagctgaggcggcaacaacagattgaacgtgagctcaatgggtacatggagtggatctcaaaagcaggtgaggccctttcatcctggggcccagggatggagatcccaggccacggagtacaaagagagtcatgcagtttggagaaggctaagctgggagggttatgatgggaggagaaagagaacctgaattggtagtcccaaattttatcaacaagaatccagagtctgatatgaagaagtctaagatgaagccaggatctgacatcacgtaacttgaattctgaaatcagacgctggtttacatcccggccctgccactttttacccatgcaccacacatccctgtacctccgtttcctcagctgttacatggaggcgatggtagtgcctaagtcatagtactattggagtatttagtaaaataatctcagctgagtcacttggggagagaagtgcctgatacacggtaggcacatatttatttgttcagccatttaacaaacatttagggagcacctgctgtgtgccaggcactgatctaagcactgaggatatgggagtaaacaatacacaccaaatccctgccctcagagctctgatattctaatgagagagataaagcaaacaaatacatgtcatgttgggaactcccaaattcagagaaggaagataaaacagactaggaagataaaacagagtaggaagttggccgggcgcggtggctcacgcctgtaatcccagcactttgggaggctaaggcgggcagatttcctgaggtcaggcattcgagaccagcctggccaacatggtgaaaccctgtctctactaaaaatacaaaaattagccaggcatggtggcgcacgcctgtaatcccagctactcgggaggctgaggcaggagaattgcttgaacccaggaggcagaggttacagtgagctgaggtcgcaccactgcactccagcctgggcaacagagtgagactctgtgtcagagaaaaaaaaaagagtaggaagttagaggcagggtggtcagggaaggcttctctaaggaagtaccctctgagcagagagacctgaaggacgtgaagaaggaagctgtggggatgtcaagggaaggggcattccaggcagagacagcaagtgcaaaggccctgagctaggaacgtatttgagacacagcaaggaagccagtgcagctgaaacagagtgagaggtggggacagctggaggagaggaagacaggaaggtgatggagatcagatcaagcaggggcttataggctgtggtgtggacattggtttttattttgcgcgaggtggggagaatgttggctattgctactgttgcggaggtggggcttgaagtcacaaaccacccagcagcatgttttttggtcggttgagctgtcaccatcagtcagcagagaatgggggtggccgggcagacccttcttcctggtccaagggagaactcatcctccaaatgcaggagcttaactctgtgctcttcctcttcagaagaggtgatcctcgccgaggatgaaactgacggggagcagaggcatccctttgatggtaactgctctaaacccacctcaggggtgggtcccaggggagaagggagaagctgtggtggggagtcgggggagagcaggtgactggttctaaggatcttgcagagggtagacgttcctcttggaggaattttaggacttccatgcagagtttccctattctggcctccacttttttgttttaaccatggacctggttttttctgctttgtgccttggtttttctcatctgcaaaatgggtatgatataaacaataccctagctcacgagattgtttctcagaatgatattcgttatggcaaatagaacacctgggatagtgcctggcatggggtcagcacgtttctgtttgctaaataagtaataattccaccaataatccagtttactgtgaacggctgctgtctcccatgttagaaacttaacgagacagaaccatgactttctttcttttcttttttttttaattgagacagagtctcgctctgtcacccaggctggagtgcagtcacacgatctcacctcactgcaacctctggctcccaggttcaagcaattctctgcctcagcctcatgagaagctgagattacaagcatgagccaccatgcctggctaatttttatattgttgatagagatggggtttcgccatgttggccgggctggtcttgaactccttgcctcaaatgatctgcacaccttggcctcccaaaatgctgggagtgtagatgtcaattcatggtcccctggaaacctgaatatgaaaggagggaccattaaaaaggtgtccaaaagcccaacctccccagcatagctgggagtcaggggacagactgtaagagtcactgtgtatccaacctgaggcttcatgaaagtaaagtttcctagaatttagagatagggttggatgcggtctgtctgtggctcacatctgtaatcccaacactttgggaggccaagacaggaggaacacttgagcctgggagttcaagaccagcctgggcaacataatgaggttccgtctctacaaaaaataaacttagccagatgtgggggcacacgcacctatggtcccagctactcaggaggctgaggtgggaggatcacttgagcccaagaggtcgaggttgcagtgggcaccactccactccagcctgggtgacagagtgagaccctgtttcaaaagaaaaaaaaagaatttagagataggccagaataatatgtctgcaatataataataacagcaataagaaaaataatagtactccctgaaaaatgcaacttcttgcttgagatttatcttctcatactttagaaaactggttagacaggggctgggcgtggtggctcatgcctgtaatcccagcactttgggaggccaaggcgggtggatcacttgaggccaggagttcaagaccggcctggccatcatggcgaaaccccatctctactaaaaatacaaaaattagctaggtgtcatggcacacgcctgtaatcccagctactcaggaggctaaactacgagaattgcttgaacctgggagacggaagttgcggtgagccgagatcacaccactgcactccagcctaggcgacagagcaagactctgtctcaaaaaaaagaaagaaagctggttagacagggtgatgacttttgattaaaaatctgagagatttgagggaaataaaagaactggcactgcgtcccagaaggttataaaatgaattttattatcttagttggggaggggagattacctaactcccctaaatgagttaggtaatctaactcatttagggtacctaaatctttttattggaagtctacacctgaacttgtctgctgtggagcccctggggtgtatagcttgaatatgggggcagaatcccaaaattgcagcctgcctagcgagtatgctacaggtcaaggggtggactgttttcataagaaagtgaggtttcttagaatttaaaaatagaggctgagtggggcggctcacgcctgtaatcctagcacttttggaggccaaggcaggcaaatcacttgaggtcaagagtttgaccagcctggccaacatggcaaaaccccatctctactaataatacaaaaattagccaggcgtggtggtgcatgcctgtagtctcagctactcaggaggctgagggaggagaatcgcttgaactcaggaggcagaggttgcagtaagccaagatcacaccactctctgggtgacagagcaagattctgtctcaaaataaataaacaaataaataaataaaccagaaggaaaatagtggctgagggcccagacctggagtcggactgaacccgacttgattcttgtctttacccctttaagcaaagtgatagtgccaccttgaacctcagtttacacatctgaaaaatgggtatactattagttcccgtgagaacagttgccgtgagagttaaatccaaggacacactgtgtccatatggtctgtgttgcaaaaagggtaacgtctttttctcttgccatgtttccattgttggagctctgcggagaaccaccataaagaaaagcaagacagatttgctcaaccccgaagaggctgaggatcagctggctgatatagcctctgtgggtgagtcccttcctctgccacctatcagttgttcatcacctatcgcccaagagacatggtggggtgggggcagagggcttgcaaaccgtgctgcctggatttgggtctcagctccaccctttcccacctgtgcgtgtgtcctgggcagattacatcattatgggaataacatccgtgcctagcttctcattattttgtgggaattcaactaaatgatccccatgaagcatggcaaaccagcacctggcagggacgaagctcccagtcaagttggtgaatgtttgtgactcattcgggaagtattcatgggggacctgcttatattaggtgcttggttgcaaacaagacaaggcagtcacgaggctgagctgggaggatcacttgagcctgggaagtggaggctgcaataagccattattgtgttactgcactccagcctgggcacagaaaaaaaaaaaaagacacaaactgagccaggcacagtggctcacgcctgtaatcccaacactttgggaagctgagatgagcggatcacctgatgtcgggagttcgagaccagcctggccaacatggtgaaaccctggctctactaaaaatacgaaaaaaattagcctgtagttccagctactctggaggctgaggcgggagcatcacttgaacctgggaagcagaggttgcagtgagctgagatctcatcactgccctccagcctgggcaacagagcaagatcctgtctcaaaaaaaaaaaaaaaaaaaagacacaaaccaaatccctacctacatggagctcacagtccagtgcaggaaatagaaattaaacagagaattacacaaataaacctgtaatggtaatggcacttcagggagaggctctgggcttagcttgctctagaaggatggggagcagtcagggaaggctacctggaggaagtgacggttaagctgggaactgaaggatgggtaggagatcactgtggtggtgatagcagaaggaacagtgtgagaggcagggctcagacctttgccaccacaagggccagagttcgagggaggagggaacatttattctttcccttctcactcctctgtcctattgattcattggctgtgatgatgttgattttgaccttctaaagtgagaatgtattgttattgttgttgttgttctttaatgggtttttgtttttaatggaaggaagagcatccaggcagaggaaataagactggaataagattgaggggagaaggaatttaggctgcttgggaaactgtgtggccgcagtttagaggaagaaaggatggcaagagaaagaggaagggaggaagagaaggagggagagaagtgaaggaaggagggaagttagtacatccatgtgtttctgatccatagtttctgatccactatttcgtattccccttttatcgctcgcccctagtttataaccttattgctgagtttaggcataatttccattgcgatcacatatctcgtagggtggatacactatggtttgtttagccatagctctattatagggtgtttgagttgtttccaataatttctcttacgaagaacactgctgtgcacatttacgtacaatgactccccccaccctttgggcgtatttccttggggataattataggatcaaagatattaacagcttttcaactcattattcaaagagccattctgagtttcaaaaacatggaacccatttataaacctgccaagtatgcatatgttcatggattccccacccaggccatcgaatattaccaatttaatttcctttcccagttaagtgggtttgtaatgaaaccttaaagcttgttttcatttgcatttttaatttccagccaaaacacgcttttctttgtaatggagaactcattctgcttccactcgtgtgtgcatctgtttaatttcctgtaagcaaatgtcaagaattggagcgctcagtaggtgtcttgagtatttgatcaattatgtctgtctcacgtgttacgttacctccattgtttaaaatctgttttatgacgaggtacagtggttcacgcctgtaatcccactgctttgggaggccagtgcaggaggatctcctaagatcagccgttcaagaccagcctgggcaacataacaaggctccatctctgaaaaacaaaatgttgaaaaacttagccaggcattatggcacacacctatagtcccatctatttaggaagctaaggcaggaggatttcttgaacccaggaattcaaggttgcagtgagctatgattgtgccactgcactgcaacgtgggcaacagagtgagaacctgtctcttaaaaaaataaaataacatacattcttaaaaatctactttgctggccgggcgcggtggctcacgcctgtaatcccagcactttgggaggctgaggcgggtagatcgcttaaggtcaggagtaggagaccagcctggccaacatggtgaaaccgtgtctgtactaaaaattcaacaattagctgggtgtggtggcgtgagcctgtaatcccagctactcaggaggctgaggcacaaaatcacttgaacccgggaggcggaggctgcagtgagctgagatggcgccattgccctccagcctgggcatcaagagtgaaactccatcaaaaaaataaaaaatctgcatatacatatatatgtatatatatttttaatttttttaatttttttttttttttctgagatggagtcttgctctagcacccaggctggagagcaatggtgccatctcggctcactgcagcctccgcctctgttaacaaggcaggtgacattgcagctttctaaacagacccaaaacccaggccagtggcttgttctttcatagccacgtttgctacaggcaaatccaccaaaacccacctcatcagcctgattactcaaaaagacaaagaaaggagcccccaatctagccagtggttttctagaccaccccaaaagagatctctggaattccaggattctggcaaggaatcacatttagctttatttatttatgtaaagaatgcaacaatacaggctgggtgtggtggctcacgcctgtaatcccaacattttgggaagctgaggtgggaggatcgtttgaggtcaggagtttcagaccagcctaggcaacatagtgagaccctgtctctatcaaatattagctgggcattgtggcacacgccagtagtcccagctactcgtgaggctgaggtggatcacctgagcccaggaggtcaaggctgcggtgagccacagcatgcccctgcactccagcctgcgtgacagagacttcatctcaaaaaaaaaaacaaaaaaaagtaataatacagtaatgcatatttcaaagtaaggtgggagctatgtggtatttgcgttcacgttcacattataccacagtatgcacagtccttttttttttttttttgagacagtgtcttgctctgatgttcaggctggagtgcagtggtgcaggcatagctcactgcagcctcaaacccctggactcaagtgatcctcccacctcagcctcccaagtagctgggactataggtgtacactgctacactcagctaagttttttatattttttactagagatgggatctcaatatgttgcctaggctggtctcaaactcctggcctcaaacaatcctcctacctccacctcccaaagcagtgggattacaggcgtgagccaccacacctggcccacatgcagtcttatataattggtgattctactgcgctgttgaatcagttgataaacgcactataaagcaggttcattcctaattgatgaacttactgctgaaataaggaacttgaatcatttacatgaaaagttgagccatgttgctgaaaggatatcaatttttttttcttttttttctttttttttgagatggagtcttactctgtcgcccaggtgggagtgcagtggtgcgatctcggctcactgcaacctccaccttccaggttcaagcgattctcccacctcagcctccaagtagctgggactacaggtgcacaccaccacgccctgccaatttttgtactgttagtagagatggggtttcaccatgttggccaggctggtctcaaactcctgacctcaagtgatctgcccacctcagcctccgaaagtgctgggattacaggtgttagccaccgcgcctgacaggatatcaaatttcatttagactgcaggaatacgttcaagagatctattttgtacagcctggcgactgtattaataacaatgtattatatacttgaaaattgctcagagagtaggttttaagcattctcaccgtgagaaaagtgataagcatatgtaataatgcatatgttaactagctcaactgagccactccatagtgtatacatatggtcaaaatatcatgttatgcactataaatagatacagcctgtatctgtcaatttaaaataaatgaataataactttaaaaagaaaaataacagtatggctgggcacggtggctcacacctgtaatcccagcactttgggatgccaagacaggcttgaggccaggagtttgagaccagcctggccaacatggcgaaactttgtctctaataaatatacaaaaatcggctgggcatggaggcgggcgcctgtaatcccaactacttgggaggcagaggcatcacttaacctgggagatggaggttgcagtgagccaagatctgcactccagcctgggtgatagagtgagcctttatttatttctgtaaagaatgcaataatacaggcctggtgcggtggctcatgcctataatcccaatgttttggaaggccaaggtgagaggatcatttgaggctacaggcgcatgccacagtgcccagctaatacttgatagagacacggtctcgctatgttgcccaggctggtctcaaaaccctggcttcaaatgagcctcccaccttggcctcccagagtgttgtgattacaggtgtgagacactgtacctggcctgtattaaaaaaaaaaaaaagaagaagaagaagaagaggaggaaagaagaagaaggaagaaggaagaagaagaagaggaggaggaggaggaatgggaaggggaaggggaagaagaagaggaggaaggggaaggggaagaagaagaggaggaggaaggggaaggggaagaggaagaagaagaggaagaagaagacgaagaagaagcacaatgataaataagtaaaatgtggagcatatgaaaacaaaacaaaaaaaagttgatccattatgaatggaagctgccattgtaactctgcttttttaggaaaaccagaccccatttagatgattttatttgtttttaaaggcaggttcttgctctgtcactcaggctggagtgcagtgatatgatcatagctctctgcagcctggagctcctgggctcaggcgatcctcccagcttagcctcccaagtagctgggactacaggcaccaccacacccagctaatttgttgttgttgttgatgttgttgttgagatggggtctggctatgttgcccaggctggtctcaaactcctggcctcaagtgatcctcctgccctggcttcccaaagttctgggattacaggcatgattttttattaatttatttgcagctgacaaatggtaattgtgtatgtttatggagtgcagtgtgatgttttaatctatgtatacatcatagaatgattcagtcatgctaattaacacatccatcgcctcaccacctcaccgttttttgtgtgtggggaaggcattaaaaatctcttagcaattttgaaatatgcaacacattactatttattaataatgcaatataaatacacaataatgtattaatgcatcactaaatgcgatgcaatgcaatgcaatgcaatagatcactaaaacttactcctccagtctaactgcaacttataccctttgatcaacatcttctccttctcaatccctcctcctcccctgcagcctccaggaaccaccttcctgctctttctatgagatcaattttttttagttttaagctcccacatgtgagatcatactgtaattgtctttctgtgccagcttattttactcagtataatgtcctccagttctgtccctgttgtcacacattacagaatttctttcttttagggctgtatagtattctatttgtatacataccacattttctttatccattcatccattgtgggacacttagtttgcttccatattttggctattgtgaataatgctgaagtgaacgtgggagtgcagatgttctgaaaagacttaaatgtcagacctgaaatggtaaagatgctccaagaaaacataaggagaaagctccatggcattggtctcgggaatgattttttggacaggacctcaaaagcacaggcaacagaagccaaaatggacaaatgggatcgtatcaaactaaaaaatttgtgcacagcaaaggaagcgttcagcagaggaaagagacaacctaaggaatgtgagaaaacgtttgcaaacaatacatctgataaggagctaatatccaaaatatataaggaactcaaacaactcaacagcaagaaaacaacccaattaaaaatgggcaaagacagctactcgggaggctaagatgtgacgatcccttgagcccgggaggaggaggttgcagtgagctgacattgcatcactgcactccaccctgggcgacagaaggagaccgagaccctgtctcaaaataaaaaataaaaatgtgcaaaggatctgaacatacatatcccaaaagaaaagacatacaagtggccaacaggtatatgaataaaatgctgaacatcactcatcatcagggaaatgcaaatcaaaaccaccattagctatcacctcacacctgttagagtagctattatctttttgtttgtttgtttgttttttgttttttgttttgtttttgagagggagtctcactctgtcacccaagctggagcgcagtgttgtgatctcagctcactgcaacctctgcctcctgggttcaagggattctcctgcctcagcctcccgagtaactgaaattacaggcacacgccaccatgcccagctaacttttgtatttagtttcactatgttggtcaggctggtcttgaattcctgacctcaaatgatctgccctccttggcctcccaaagtgctgggattacaggtgtgagacactgtgcccagcctagagtagctattatcaaaaagacaaatgaggtttgttgaagttctaacccctggtacctgcaaatgtggccttacatgaaaatagggtctttgcaggtggtaatcaagttaagatgagatcaaacttaattagggtgggtcctaaatccaatgactgctgtctttataagaggagaagcaggctgaccaacatggtgaaaccccatctctactaaaaatacaaaaattagctgggtgcagtagtgcacacctgtagtcccagctactcaggaggctgaggcaggagaattgcttaaacccaggaggtggaggttgcagtgagcagacgtcatgccactgcactccagcctgggtgacagagtgagactccatcttacaagaaaaaaaaaaaagacaaatcataacaagtgctggcaaggatgtggggaaacggggatccatttacatcattttaataacacaggctctatatgggtggtattgagttcccagagttgccattacaaaatgtcacaaacccagtggcttaaaacaacagaaatttcttctctcacagttctagaggccagaagtccaaactgaaatcaaggtgtcagcagagccaccacgttccctcagaaggttttaggggagaatctgttccatggtattttcttagtttctggtgctgccagcgatacttggtgttcctcagttcatagatgcataattccagtctctgcctctgttgtcatatggtcttctttctgtgtttctgtatgcgatttcttttttttttttttttttctgagacaagtctcactccatcacccaggctggagtgcaatggcacgatcacagctcactacaaccccaacctcacaggctcatgccgtcctcccacctcagcctcccgagtagctgggattacaggcgtgtgccaccatgcccggctaatttttgtatttttagtagatacggggtttcaccatgttggccaggctggtctcgaactcctgaccttacgatctgcccatctcggcctcccaaagtgttgggattacgggcacgagcccaccgcacctggccctaattactttatttttttgtaaatttttttttgtaaatttcatgtagcctgagcatacagtgtttataatatatacaggagtgtacaataatatcctaggccttcacattcactcaccactcaactcactccctcaccaagagcaacttccagtcctgcaagctccattcatgccaagtaccctatgcagctgaaccaccttttctcttttatactgtgtttttactgtaccttttctatgtttagatatgttcagacacacaaatactatgatgttacagttgcctacagtattaagtacagtaacatgctgggcaggtttgtagccgaggagctacaaaccacgtagcctgggtgtggagtaggctacaacatctaggtttatgtaagttcactttaagatgctcacacaaggacaaaattgcctaacaatgcatttctcagaacacgtctccctcattaagccacacatggctgtattacaatttacatataattttaagcgtatataaattgccagaaatcaccagatgaatccttggcggtgacataccccttcccccaccatagaacattgcagactggcccggacgcccagtatctcatgcctgtaatgccagcactttgggaggctgcagcgggcagatcacttgaggttaggagttcgagaccagcctgaccaacatggcaaaacaccatctttactaaaaatacaaaaattattcggacgtggtagtgggcacctgtagttccagctacttgggaggctgaggcaggagagtcacttgaacttgggaggcagaggttgcaatgagccaagatcgtgccactgcactccagcccgggtgacagaatgagactctatctcaaaaaaaaaagaaaaaaaaaaaaaaaggaaaagaacatttcagactggtaccagttacaccggctcttgatcccttgaatgtggctgaccctgaactaggatgtacttcataataacacgtccggctgggaatacttagtacaaaagaaagagtataaaatatcttttgaatccaccttgatattgattccatgttgaaatggtaatattttggatgtattgggttgaataaaacatctcatgaaagtgatttttaaaaatctagaaattgtctgcaattataattccagaccacagagaaaaacgagagacaggaatgtatagaaaaagggaacgtgggacaaagtgagtatgaaattcaactaacagaagtgacagtgcctagcatggggtccagcacttagtaggtgttcaattaatattcatttccctctcccttaccagtgaagggtatgcctgtcgtggggaatgtgtcttcaggctgagtgatcaggaaggactttctcaatggctggcacgtgaacctagtcatgatttcagctcttgaggttgtactagaagatttatatccaataatcgtaaggtaccacttagcatcacgctaagatgtattaattcatttatgcctttggatggccctttgaggtaggaagtgtggttgtctccagtttaccaaggtggcttgcccaaggtcatctgctggttggtgattaagccaggttttcagtgtggctccagcaggagtgggggctggggaccttctacctgctgtggtttctctctctctctctctctctctctctctctctctctcgatctgtggaacatcccccctgtcccccaaggtcccaagggtcttatttcttttggccaagccctttggagacctgcagatctggacacatctttgagagtttcaggaactagggccagaaatgctgggcagggtcatgaggagctgccactggggttgagaaggtgatggacatgaggggaagggtctttgcagaaaggagaggcgtccctgtaagcaggtcacagccactgggcctggccaactgcagccgagtggaatgtgcccctgccccatgaccatatgccccaggtgtgcaatgtggcggcccagagcacacactctgaaccatcttgacacatcttcactggttactagacccccctcagcctgtttccttggctgtaaaatggggatgacgctggtccctacttcctagggctctgagcaggagtaagtagcttgtcgtataaaacatgttccctgcagtgcctggtgcctgctaaatgttccataaacgtcagctgttattttcattcaggggaagctgaaatccatattttcatggaaaatctcccagtttttaaatgtggaccaataatttcagctttcacaaacccagtatgagtcggtatggcccctagggtgccaactcaaaatctctgttgagaattttgctgataggaagtggcctccttggaggtgtttgctgtgtcctgtgtctggcaagtggggtggttttgataaacgtgctggatggatgtatgggtgaatggataaatggaggaatgaatggagaaacaaatgagcaaatgaataatgaatggatggatgaatggatgagcgaatggatggatgaatggatgagcaaatgaatgatgtacacacaaaggaatggataaatgatgaatgtgctaatgaatttaagaatgatgaaagaatgaatgaataaatgaacaaatggatggatgaaagaatgaatgaatgtactaatgaatgaatcaatcaatgaagaaccatttaaaaatgaatgcaactgagggtttataagaaaaggtatcttaagcctgggcatggtaattcatgctggaatcccaatgcttagggacgctgaggcgggaggatcgcttgaacccaggagttcaagaccagcctgggcaacacagggagacctcattgctaccaaaaacaaaattgttttaattaagcgggcatggtggtacgtgcctgtagtcatagctacttgggaggctgaggtgggaggatcgcttgaacccaggagttcaaggctgcagtgagctaggatcaagccactgcattccagcctgggcaacaaagcaagatcctgtctcaaaaaaaaaaaaaaaagatgtattttagaaggtaaattcaatctgtccaaaactgagctctgaccttcccctaaacctgtgcccattcagtggatgagagctccatcccttaaggggttcaccaattcatccattcctttgtatgtacatcattcattcaccttggctcatccctctctcttacatccacaccgttccatcagcaaatgttgaatctgtcttaaatgattcatcccaaatcctccccgcttaactaccacccaactccagcccccatccatcatcatcatcacttgcctggatgggttcagtcacctccagcctggtctcccagctcccgtcctcacctctcactgtctactctcccactcggcagccagagggtgcctgtgaacacccaaatcaggttccatccctcctctactcagaaccctccacggctcccccctcactcagggtaaaagccaaagtcctccttgtggtccaccaggccatgcatgatctgcctgtcacctccctgccttcaccaccttcctcttttcccctcaaccactccactccagccacactgacttccttgtgctcttccccaaaaatgtcgggcagacacattcatgcttcaggaccttaaatttgctgtttcctctacctaagatactaaagtgacaagtcaacacactcaccttgaccatgcaatttaatgttgcagcctaccctgtggactctccaagggctcccagtccctctgtgatgctttactttttctcttaaaaaaaaaattgttatttaaaagaacttgtctcgctgtgttgcccaggctggtgtcaaactcctggcctcatacagtcctcccattccagcttcccaaagtactgggattagaggcatgtgccactgcacccatcccaactttttttttcccatagcacttttcattttccatcccactgttaatttacttattacgtccactgtctgtctcctccccttagagggtcagaccccggaagtccaggctctgttgcctaatgtatcctgagcccctggaacagagcctggcacaaaataggtactcaataaatgcataagagcaaaactatatgtaggcagaggacacacccagcttattcctcagtgatcacttctaaagttaaatgtccatggaaaacagtctcatccacatctctttctggaggccttccaagcgtgctccatgcagctctgttgcctgcccctgcatcagggaatggaggctctgctttatcctgccctgtggtgtgactcccagaggcatcagatgtggctgggagtgggagacatggaaaattggctcctgcaacagagaactatcagccttcccatcaattggttacttctaattctgttatttttcaggggcactgtcttctcataagctccatctatgcaaaactaagcccatgggtcatgatggttccctcaggccagaggcttgctggagagactaatggatcccctggctaaaatctgtgcttgggctgcacattggttaatttcttctgaaggaacagcctgagcctgacattctccatcttttccctggcaggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttgtgagtatcacccagccccacccctgccaactccctgatccctccctcacaccctttttccacttctctttctctggtagtatgtgtatcttctttggtcctcattgaatctgccctttcctttagccatttctataactgtcactggggccaatgttactgttgctatgacaatggaacccatctcccttagacctgagagctggaagctggaattcagaccaacaaatgctcctgtgattcctttctaagagagagggacagaggggtgctggtgaaggggatgttggaagagagacagagaaagacggagctcataagatagacagatagaaacagaaacatacatgtattaataatttttatgtacatctctggaaatgttcataacttatggttaagagaggatgccttagaaataaggagtggcttatatgttgccctcattttctctacttatttctgactctacttctctcttctttcaaaccttctgcttctttcctgttaggttggtgcaaaattaattgcgttttttgccttttttttttttttttttaaccacagttacttttgcaccaacctaatacttcctcccctgccctttttggcttccttattcattcatagaacatcccctccagtatctgcgagagcgttttgctccctcaaggtacaaggcccactaaggctttgccctctgggcctattcccagattctatgtgagttagcatgagatagtatcaaaattgagggccaagtgagggtgaggaaaagcagcaaaagatggggagatgtctgagcaggatttaaaaagtaaagagctcgaggaatcaacaagagcagcgactggggccaggcatggtggctcacacctgtaatcccagcattttgggaggctgaggtgggtggatcacttgaggccaggagttcaagaccagcctggccaatatggtgaaaccctgtctttacaaaaaatacaaaaattagccagatgtgatggtgcacacctgtaatcccagctactcaggaggctgaggcactagaactgcttgaatccaggaggcagaggttgcagtgagccaagatcatgccactgcactccagcctgagcaacagagagagtgtctgtctcaaaaaataaagtaaaataaaataaaataaaataaagagtagtgattgggcagtgaggggggcaggtggatgccctggctttggctcacaggccccaagtaaggacttctcaaaacgtcttttgcctactggctgtctaatttattcactgaccttctgacctggttcagaattgacttaggacagcaagaagagacagtctagtctttgacctagaaaggcccgtgagcctagtccaggccattgtcttcttataaccctccttgttcccagtcacgttggctgaccccccaggacacccctcaggaaccagttctccttcccagggccctgacctagtttcaaacttagtaattgtttttagtccctctggagtctcttataaatgaggactctacttcgtgttttaacttcctctaatactctatttttaatctcctatattctctctactaatcatcttgtacagtctgtcctggttcaggaacaagggactgagacttcctgcctgggtcctcagtgtctataaaggtcctttactcattcccactttccctttgagaaaactgagacacagagaggttaagtagattgcccaggatcacacattagcttggcatgatggcgggcgcctgtaatcccagctacttgggaggctgaggcaggagaatcgcttgaacctgggaggcagaggttgcagtgagcccagatcatgccactgcactctagcctgggcaacagagctagacgccatctcaaaaaaaaaaaaaaaaaaaaaaagatacacattaatttcagagatgtcaaaatataaacaaaaatgtatatcttggcatcagtgaagtgtagttgtttctctggatctcagactccacatctatgtggtagaaaccggatttgatggtcctgaaagttcttccagatgcaacaatgctaaggataagtaattctttcaagtcttgtgcatcacctgctatcatgtttccatggtaactgaggaacaagatctcagaaactcttcagtcctcccagagttacttctggtgggtctaggaatgtgtcagatgttacaaacagacttcctctgctgatattttggtcctaggaaccctagagttcccctcagacactaagatctccttagcgtcctataaataaggagaaattttggtgataaatactgtgaaggactttgacggtcagttcaaaacacctcttaaaagcatgacatagcaaacacccttggcaaatatcttagttcatttgtactgctataacaaattacccgagactgggtaatttgataagaacagaaatttattttctcacagttctggaggctgggaagcccaagatcaaggcattggcaggtttccctgtctggcgaaagctactctctgcttccaagattgcaccttgaacactgtatcctctggaagggaggaacactgggtccttacatggcagaaggtggaggagcaagagggacaaacttcctctgtcaacctcttttataagggcacctaatcccattcatgagagctctaccgtaatgacttaatcacctcctgaaggccccacctcttaatactgttacattggcaattaagtttcaacgtgaattttggaggggacacaaacatttaaaccatcacaaccaccaaacacaattagctttgtggccttaattagctatatgaaattcatggaagttagtttcagtcctctgtctctttcctttctgtatgctttctgctcctcagaaaccctcctcatctctcctttctatccattaagtacccacgcccttcctaactcctcatcttcctaccctaccaagaaagccctctcagaaaaggatctgatgtcagccatttatttgctggagcaaatgcatatccatgttttacccctccctgaggcatttgcaattttatgcttgctcatcaaagaacaaaaggctttgtcttactcaagactttttaggtcactcacaacacaggatttctaggggacataagacaagttttctgagttaggagaaaagccataccttaggtgggttgcctgtgtcgctccaactaagtacttaacttcaggattacaaataggatatcattatgatttctatttccttttatcctttggagctcagtcacgtagaagtagattaaatataattgttagatcacagcaccctggcattatggggccgttatggtccattgttattatgtgaattattcagttaattagtttattttttaaatgtgataaacacccaggaacccaccagtcaacacaaaagtccttggcaataatctatatccgatccttctcatcgaaccagggcaaaaactacaagatggagacccactgatatttttctcattccttttaaaatcggcctaaggttggttagcttgttggttggagggtagggcataattgttgctttttttttttttttttttttttagacaaggtcttgctctgtcacccaggctacagtagggtggcccaatcttggctcactgcaacctccacctcccaggtttaagtgattctcatgcctcagcctcccaagtagctgggtttacaggcatgtgtcaccacactggctaatttttgtatttttagtagaggcggggtttgccatgttagccaggctggtctcaaactcctgacctcagttgatctgaccgcctaggcctcccaaagtgctgggattacagacgtgagccaccatgcccagccagctcttcctttttaacagaggggaaactgaggcccatgggaaggacaccttggacagggcgtggccacagtgggtcatgtatataatcccagcactttgggaggctgtgctgggaggatcacttgaggccaggagttcaagaccagccagggcaacatagtgagacccccatctccacataaaaattttaaaaagaaaaaagataagtcagaagttgggtgtggtgacacatgcctgtagttctagcatgttggaggccaaatcagggaaactgtttgaggccaggagtttgaaaccagcctaacagcatagcaagacctcatctctacaaaaaataaaaagtttaaaaatgataataaaaggaaagtcagagccacctggaacccctaccctcagcaagcctaacctcctctctgtttcctccttctcccttctagactatgcagaattcattttcttaggactctttatgtccgaaatgtttataaaaatgtacgggcttgggacgcggccttacttccactcttccttcaactgctttgactgtggggtaagtgctcttgtttctaagagttcatttctccagctcttgcctggaatgacagatacctggacacattaaagggagaaaggtaaagtcacccctgaatatgagagactcagatggatgcagaaggaatgagaaaacaatcccaaacactggcaaggatacagtgtacccagaaccctcaaccaccgccagtgggaggaaaacgtatagaccccctttggaaagctaagtgggggacataagacaagttttccaagttgggagaaaagccatgccttaggtgggttgcctgtgtcgctccaactaagtacccaacttcaggattacaaacaggacatcaatatgatttctatttcttcttttcctttgtagctcagtcatgtggaggtagatgaagtataattgttagattacaacaccctggcattatggagccattatggtcctttgttattttgtgaattactcagttaattaatttattttttaaatgtgattaacacccagtaacccactagtccacacaaaacctaagtcctggagaataatctacgtccaatccttctcatcgaaccagggcaaaaactacaagatggagatatgacccagcattccattgctaggaattcatcctagaaaatctcacccagatacctaggagacacaggccagaatgtccctgcagctggaagtgaaattaaggttgttcgcaaataagtggagaatgcctggcccagggcagccctaatcatttaccatagtcctgttggtctcagaaaggcttaataatttatttatttttttttattttttgtttttattttttgtttttgagatggagtctcgttctgtcacccaggctggagtgcggtggcgccatctcggctcactgcaagctccgcctcccaggttcactccattctcctgcctcagcctcccgagtagctgggactacaggtgcccgccatcatacctggctaattttttgtatttttagtagagatggggtttcaccgtgttagccaggatggtcttgatctcctgacctcgtgatccacccgccttggcctcccaaagtgctgggattacaggcgtgagccaccacacccagccagcttaataatttataataactgaatgttgtactgttttctgccattatagaaaattatgttgttggagaaaacaaaatacatacaaacaagcaaaccttccctacataaatgacccaagtagttaaagaataaaaccaatttctttccattaaaaagaaaagaaagccgggtgtgatgcctcatgcctatagcctcagctattcaggaggctgaggcagcagaattgcttgagcccaggagttgaaaaccagcccaggcaacatagcaagaccctgtctctacaaaaattaataataattagccaggtgtggtggtgcacacctgtagccccagctactcagaaggctaaggtgggaggattgcttgagcccagcagtttgaggctgcagtgagctatgatcacaccactgccctccagcctggacaagagagtgagaccccatctctaagaaataaaagtaggccaggcacagtggctcacacctataatcccagcactttgagaggcggaggcaggtggatcacctgaagtcaggagttcaagaccagcctggccaacatggcgaaaccccgtctatactaaaaaaatacaaaaattagccaggcgtcgtggcacatgcctgtaatcccagctacttgggaggctgaggaaggagaatcacttgaactggggaggcagaggttgcagtaagctgagattgcaccactgcactccagcctgggtgacagaatgagactccgtctcaaaaaaaaaaaaagaaaaattttaaaatgtcctgagcaaccttgtttgtaatagttccaagtctcaatatccgtgtatccctttgctgtagaacagataaatattttgtggcatatctatataatgaaatactctgtgacaatcaaagtccaccaacagcagccacatgcccaacaacaggaatgaatctcacccatgtaacatggcacagaaggaggcaggagctagcaacgtaagtccatacagttcatgcaaagttcaagtggacaaaattaaactctctctctctctctacatatatatatatatatatatatattttttttttttttttttttttttttttttttttttgagacagagtctcactctattgcccaggctggagtgcagtggcgcaatcttggctcactacaacctccacctcccgggttcaagccattctcccgcctcagcctcccaagtagctgggattagaggcatgcaccaccacccccggctaattttgtattttttgtagagaccgggattcagcaatttgcccaggctggtctcgaaatcctgatctcaggtgatccacctgccctggcctcccaaagtgctgggattacaagcgtgagccaccacgccccgccttaaactgtattttttaaggatgatacttgaatacgttaaaaaggcgaggaccttgaaaacacaacgctcggtaaaagaaaccaaacacaaaaggtcaagtattgcataattccatttgtatgaaatgtccagagcaggcaaatccatagagacagaaagtagattagtggttgctagggtctgggtgagggagagtggggagtaactgctcatggggacagggcctcctttgggggtgatgaaaatgttttggaacttgatagaggtgatagttgcagaatattgtgcatgtacctaaaggcactgaattgtgtaattcaaagtgtgaattttatgttatgtgaatttcacctcagttttttttaaggtaagaaaatggttattacaaaattcaggatggtagttatatcacagtgtctctggaaacttccagggtatccacatgtccctttttattttattttattttttattttatttgagatagggtcttgctctgttgcccaggctagagtgcagtggcaggatcatgaccctctcctgtctcaaattcctaggctcaagctatcctccctcctcagcctcctaagtagctgggactataggcacatgccaccatgcttgactaattttttttttttttgtaaagtcagggtttccctgtgttacccaggctggtcttgaactcctgggctcaagtgatctgcccacctcggcctcccaaagttccagaattacaggcatgagccactgccctagccttctcctaattgttgacataggtagtagttgcatgacattcactttgtaattatgtgtttcaggaattctcaggcctgtgggagctcttaataaataaaaaagaggccaggtgtggtggctcacgcctgtaatcccagcactttgggaggccgaggcaggcggatcacgaggtcaggagttcgagactagcctggccaacacagtgaaaccccgtctctactaaaaatacaaaaaattagccgggcgtggtggcgggtgcctgtaatcccagttacttgggaggctgaggcaggagaatcgcttgaacctgggaggcggaggttgcagtaagctgagatcgcgccactgcacaccagcctgggtgataagagcaagactccatctcaaaataaatgaataaataaaaataaataaataaataagaggccgggtgcagtggctcaatgctttggaaagtggaggccaacagttggagagaccaaagcaggaggatggcttcagcccagaagtttgaggccagcctgggcaatactagcgagacactatctctataaaaatgttttaaaattagccagatgtggtggggcacacctgtaatcccagctactcaagaggctgaggtgggaggatcacttaagcccaggaggacagtgctgcagtgagctatgattgcgccactgcactccagcctgggtgacacagtgagacccggtctctatagataaatgaatggatgaatgagggggtcaaggatcctcacccggcttccatttggagggaggagtttggttgagttcttgcaaggttggtacctaggaaatgcttgccagttctggagcccagacactgtccctggacatgagaccaggttctctgccctaggttatcattgggagcatcttcgaggtcatctgggctgtcataaaacctggcacatcctttggaatcagcgtgttacgagccctcaggttattgcgtattttcaaagtcacaaagtaagtctttggggttcctggacatttgtacagggggtggggatgggggacatggtggggccgcctccagaaagttgggaaagtgagcctcgtgtttcgagggctgactccggggccctgcctcccccgcctggcctgagtcctcgcctggcctctgtcggcaggtactgggcatctctcagaaacctggtcgtctctctcctcaactccatgaagtccatcatcagcctgttgtttctccttttcctgttcattgtcgtcttcgcccttttgggaatgcaactcttcggcggccagtaagtccttcacaggaattccaactcctggttccctggggtcaggctcagggaacacacagtcccctccaccgtgcaggctgccttcctcgtagcccagacacccattgcggtcacccaaatgggcagggccctgggtaccactcagggtttcctggggacagagatgatggagacgttcgtttccttggagatgagatactgagccacaccctcagagcaccccgggtggggccaacgtgaaatgtctgtgtcctccctgcaggtttaatttcgatgaagggactcctcccaccaacttcgatacttttccagcagcaataatgacggtgtttcaggtacagcctccacctggccccacgggccaacacctctcagtgtcacagatgaaagtgcctgctccacatccaaggggcttccctgaactcctccttctctacctggccttttcacaccactttgaaacacagattttatggttatcattattcaattatggtgaggccaacagatcaggagatgaatgtcattggaaagatagtttgtggctgggcacggtggctcacacccataatcccagcactttggccaggtacggtggctcacacctgtaatcccaacgctttgggaagcccaggtgggcggatcacttgagatcaggaattcgagaccagcctggccaacatggtgaaaccccatctctactaaaaatacaaaaattagccgggcgtggtagcacatgcctgtaatcccagctactcgggagatgaggcacaagaattgcttgaacctgggaggcagaggttgcagtgagccaagatcgcgccactgcactccagcctgggcaacagagtgagactccatctcaaaaaagaaaaagaaaaaaaaaaccactttgggaggtcaagatgggaggactacttgaggccaggagtttgagacaagtctgggcaacatagtgagactccgtctctgcaaaaaaataataataataattagctgggcatggtgatacatacctcctagctactagggcagctgaagtggaaggattgcttgagcccaggaggttgaggctgcagtaagctacaatcacaccactatactccagcctgggcgagagagcaaagccctgtctcaaaaacgaaaagaaagtttgttatactcacagatcctcagagaaggagcacaccatgcaggaccaagcagagaagcaacagggtcaagcaggaagagaaggaaaatgtgggcaagaggcttgattgtggtttccatgggacggaatgggtgaggcagagtaaacagctcgagactggctagtttggatcatttcagtgggctctggggcagaggagctgttcctacttgtctaggacctggccttggggtgattagggcaggtggatagtgctgggaagataaaggaggtggttgggatatgggctggttgggatattgtttggtttgcttttaaaaagcctgctcagggctaaattgtttactacctctagggactggctagtgctggaccgggcagtccctccagagtcagcaagaccccagatgcatcagaataaagaaaataaaatgcgtggccaggccaatgaggtggttcatgcctgtaatctcagcactttgggagaccaaggcgggaggattgcttgagcccaggagttcaaggctgccgtgagctccagcctgcaccacagagcaaggccctgtctcttaaaaaaaaggcagagaaaaaaaatggctaatacacccatcaaatctgaagataccttggtctcatattccagggtgatcaacccaaagcaacttctgcacccatgtgggcgcattccctgaggcttgggactggcccagccgggaccttcagagcatctttggtggattctttctctttgagggactgagagtgtatagaaaatgtgacttcactctctccttctcctggggaggtagtttctaaatgagaccccaagacagggagttgaagaggaaaccttccatgaagggaagttctgagcccccacataagcgattttttttttttttttgagatggagtctcgctctgttgcccaggctggagtgcgacggcacgttcttggctcactacaacctctgcctcctgggttcaagcgattctcctgcctcagcctcccgagtagctgagactacaggtgcatactaccatgcctggctaatttttgtatttttagtagagacagggtttcactatgttggccaggctggtctcgaactcctggcctcgtgatctgcctgcctcggcctcccaaagtgctgggattacaggcatgagccaccacacctggcccataagcgattattaatagcactgatcgctagtcatgtatctttagctcagaggttctcacccaaggacaagtctgtcctccaaggacatgtagcaatgtctgcaagcattgttggttgtcacagctagggagagggtgctactggcatctggtgggtggagactaggaatgctgctcaatatcctacaatgcacaggacagccccaaatagaataatctggccccaaatatcagcagtgctgaggcttagaaaccctgttttagcagattcatgtttttggagttctttaacatttactttatcctcatggggatatggatagaaggaaggaagttggatcttttttaaaggagcatgtaggtgctgtttgaatatccccttggttctttcagtatgcatcagcacaacttgcgtctgtcaacacctaatcctttgccttggtctttctctggtcccctgctctgcccccaaggaactgcagtccagcagtactgtgaattttttgtgccacaccttaaaaggagcagccgttggtggataaataccccagctccctcaccctcaggtgggatgacccctagagctccccagcaagaccaagccccggttacctacagtggaaactcgcttgatcacatactgtttacgttccaccctcttttcccttttctcacttctcctctcccctactggtgcttcctgagatcacctcccagacaaaccacttgcacccgaacccttgttccagggtctgcctcaggcagggggaccccaaacgtgtccttgtgctacatttgtgctatccacgtagtagcttgtttaatcatcaccatgaccacatgaggaacacaggtaaatattaaaatcctgtcttagtctgctcaggcagccataacaaaataccacacactgggtggcttatacaggaaacatttattctctcatagttctggaggccgggaagtccaagatcaaagtgttagcagggttagttagttcctggtgagggccctcttcctagcttgcagatagccaccttcttgctgtgtcctcatatgtcaaagagagagagagagagttgtgatgtttcttcctgttctttttttttttttttttttgagacaaaaatctcaaaaaaaaatctattttttttttaggcaaatcacatttttttgtcacccagcctggagtgcagtggcacaatcatagctcactgcagcctcaaactcctaggttcaaacgatcctcccacctcagccccttgagtagctgggactacagatgggcaccagctaatttttttaaattttttgtaaagatggggtcttgctatattgcccaggctaatcttgaactcctgggctcaagtgatcctcccaccttggcctcccaaagtgctgggattacaggcatgagccatggcatgcggtctcttcctgttcttataagggcactaataccatcatgaagtcccccatgacctcatctaaccctagttacctcttaaaggccccatctccaaataccatcccatcataggttagggcttcaactcatgaatttggaggcgggcacaatttagtccataacaaatccccttaatcacatcaagtaagacagagttacaggagggtctgtgactcctccagggtcccattttcctagaagccaggctaagagccccacgacgcaggaacggccctttctactcgcaaacaaagagaaaagccaaggagaagccaacacggagtctggctctgcaaaccgggcaggattgttaaagacctcctgggctcggggatggggtgggcggattccggctccacagctgcatctccaaggggcccgtggctgagaggggggttggctgtgtgtttcttcctcccctttcagatcctgacgggcgaagactggaacgaggtcatgtacgacgggatcaagtctcaggggggcgtgcagggcggcatggtgttctccatctatttcattgtactgacgctctttgggaactgtatccttcatggagagagagaaggggacaggcctggacctctggcagaggagaggttgcaggggctcaagggagggtactgagagacccagatacccagggcccaagtggtgtcccaccagtggttgcttttcctgactcagacatttgcagacaccctcctgaatgtgttcttggccatcgctgtggacaatctggccaacgcccaggagctcaccaaggtggaggcggtgggagaatgtttctctggcaaagttaccacctgcccatggcagatcaggacgggggtgggggtgggggtgggggtgggggtgggggcatgggaacagggttagaacttttgccggggatgcaccatgcaaagagaaggcgcctctccccccactcccagaaacagactgtccctcatcaagcaaattctacagccaagagggtgggaagggggaaggcagtgaggtcgctgcaggaaacggatggcaaactcaaccaaaaggccgtttacagggagtaagcagggtttccaaggaatggtgtagcccccaggctagtggatgggagagggagtgctgttatggggacccagtcagagctggggccaaggaaaaagggctgccaccagccctgggaccttagagaacccagaaccatggcaaggcacagatggagtggccaataaatgtccccaccttctctcttcctctggcttcccgctggagcctccccttagccaaacgcagcatgttaagagctagcctccgtccagcctaagcctctccccaaggaccctattaagttaagattacatgtaacaggtacagggtcttcctctcagccctggggtctccctcagcattgcagccccacctccagtgcctcgaggtattcaggacatgtttgtgaaattgaaccaaaccaagcagacgttgccaacgctccatctgccggccctggcaggagggagagagagtttcccggccccagctcccagtggagggaagcggaagtctctgccatcccaagcacacggccacaagcctggccactgtggagctggctggcatggctgagccgagggctgatccagccatgagctcatccaagttccaagagtccatccttaggggctggtgcaggagggtagcagaaggggagggagaaaggccagttcgtttatctcctgggaggtgtggacattcctctccagatccacattctttctttcattgatcctacaagcatttcttggtcatttaatacgtgtttttaatcctattcagtcctcatggaaaccttaggagccaagttctctgagccccattttacagatttcatcattcagtaagcacttaatgagcacctactgtgtgaccaaggccctggtctaggacttagggattaagcagtgaacaaaaaaaggcaaaaatccctgcctccgtggagcagggattcaagaggggagacagacaagaaacaagataaatttgtaaacatacgtagcttgtcagttggtgataaacacaacagagaaaaattcagtagggaaagtcagggagagttggaattttagatgagatgtgtgtcgcacagagaggttgagagacttgcccaaggccacacagcagtaagttgtggagctgggatttgaacccaggccgtctgggtctgcagcttgtgctcttaactgctgtgtaccagttgcttgaatttgggcatgttttatgctcacttgggaacctgtgggaaatgcagattccagggcccagcactggttctatagattatttggggagcctgaggatctgcattttaggtgtttctgaggcagatggtccagagacctagctctgaaaaatgctgggaatggtgccaggaggggtgggggtggccctatgagagcagggtggccagccagatcccatctccatgttgtctctgacagtgtcctgatctgaccatttccaaggtggtaaggttgctccccgttccagtgattcggagcacagcgggagagctgcctgcaatggcatgacttttcttatgggcgggttcatttctggccatttctttctcgttgccttttctttgctttttctttgttggcttttctgttttacgaatgaggccctgcatgaaggctgaagaaggatttaaagtccaaaaacgtctttttctgtatgtatttttaaaacctcttcccccattctcctcctctctgaacctaaccaccagtgagcagcagcaccctgggcagttggctgtagcccaagtgccctgctctcctctccccaccgccttcctgtcatgggggctgggaatataaattcctctcctcattctccttctgggggctgttgacagtgcatggcaggggccatcggatgccaggctcttctgtgtgtgagggtagttggtgttttttgaaagttggttcagagagttcacatggctcagaaagcctagtgagaggaaaatctttgcactgctttccagctcattaagacaggatgcaggggccaggcatggtggcacatgcctggaatcccagcactttgggaggccgaaatgggaggatcatttgaggccagaagttcaagaccagcctgggcaacatagtgagaccctgtctctacaaaaaaaaaaaaaaaattaaatgtatacaggcatagtggcatgcacctgtagtcccagttgcttgggaggctgaggtgggaggattgcttgagcccaggagttcaaggttacagtgagctatgattgtgccactgcactccaggctgggcaaccaagggagactctgtctctgaaaacaaacaaaagaaaaaaaaataggctgcaggaaagtcttcattgtaggaagagaagggacatttttattttttgttatctggctgtgtgttaaaataggcttcataatgagttagatgtcaaacttatacacagaggggatagcaatacacttaaccaatagcaggtacccattccaattggggagccttggttctgattggtcgaaatatttcaaatgttgcccctggtcagcaacagggtcagaagtgagtccccaaggcctagttcatgttttgtgaacaaagattccacgtgccttttaggacgagcaagaggaagaagaagcagcgaaccagaaacttgccctacagaaagccaaggaggtggcagaagtgagtcctctgtccgcggccaacatgtctatagctgtgtaagtgcccctaatccctgggatgctaccctggctcctgaacgtccacactatcccaggcacagatttgggaagcagtgggggtggtccttgacagaactgagctttaggaagagacacttcttgtccttccacccactttcactcaataaatatttggttagcagctgttatgtacccagcactgttctaacttctggggatacagcattaacaaggaggaaaaaaaaaatcccacctgtgtgtagccattctagcaagggaaggagtcaataaattagataaataagtaaattatatattgtgttagaaggcgatggaactacagagaaagtaggggagggaaatagcaaatgctgggagtgaagagagttgtgattttaaacgaagttgtcagggaaggcatcacctagaataggggtccccagtcccggggctgtggactggtaccaggccgaggcctattaggaacggggctgcacagcaggaggtgaacagtgagcaagcaagcattaccgcctgagctccacctgccgtcagatcagcaggcagcattagattctcataggaacacaaacactattgtgaacggtgcatctgagggatctaggttgcgtgctccttttaagaatcgaatgcctgatgatctcaggtgaaacagtttcatcccaaaaccaccccccacacctaggtctgtggaaaaactgtcttccacaaaactggcccctggtgccaaaaaggttggggactgctcacctagaaggttacatggcctgaaggaggtgagggaggagccactggggggcctggggaagggcatcccaggcagagggaacagcataggcaatggccctgaggcaggaacatgcctgatgtgaaggaggcctgtgtgactagaatcgaatagtaagtgtgaggaggtgaaggcaaggaggtgacaagcagattacacagggccttctgggtcaggggggaggacttgggcttttgcccctagccaggtgggagccatggagggttcttgagcagaggaggctgggacctgactcagatgctcacagactcctagcattcagtggggagtagagggtggagagcaggagtgggaggctgagatgtgggttggttcgcctgggtcatccatccaagctacagtgcctagcaatgctctaagtcctgtgaccatgccactgcaggaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaagtaagtggaggtgacctcgaatccgcagaatgacggtaacattaataatgacaacagccaaagtagcacgtgctgtgtatttgtttataaaaatatattataaaatgctgtatttggccaggcgcagtggctcacgcctgtaatcccagcactttgggaggccgaggcggatggatcacgaggtcaggagttcaagaccagcctggccaagatggtgaaaccccacctctaataaaaatacaaaaattagccgggcacggtggcaggcgcctgtagccccagctactcaggaggctgaggcaggagaatcgcctgaaaacagggggcggaggttgcaatgagccgagatcacaccaccgcactccagcctgggcgacagagtgagactctgtctcaaaaaaaaaaaaaaagtgctgtatttggccaggagcagtggctcatgcctgtaatcccagcactttgagaggccgaggcgggcggatcacttgaggtcaggagttggagaacaggctggccaacatagtgaaaccccgtctctactaaaaatacaaaaattagtggtggtgcccacctgtattcccactactcaggaggctgaggcgggagaatcagttgaacctgggaggtggaggtaggttgcagtgagctgagatcgtgccatcacactccagcctgggcaacagagcaagactctgtctcaaaaaaaaaaaaatgctgtatgtttttgtttttttgacacagggtctcgcctgttgcccaggctggagtgcagtggcagtcatagctcagtgcagcctctacctcccgggctcaagccatccgcctcagcctcacaagtagctgggaccacagacatgtgccacatgcctggctaatttttgtagagacagtgttttgtagagacagggtttcactgtgtttcccaggctggtctcaaactcctgaactcaagcattccgcctgccttagcctccctaaagtgctgggactacagggttgagccaccacactcagcctaatttttttacctttagtagaaatgaggcctggctctgttgcccaggctggtccccaactcctggcctcaagcaatcatcccacctcagtctcccaaagtgttcggattagaggcttcacagatggggaaactgagagattgagtgagctcctcaaggtcattcctctaaccagtgtccttgaacccaggctctctggcaccagaggccttgagcatttcagggaaactattaagagaagccccactgtcgtccagaattatatagtcttctgtgttcttgctgtgtgacttttgcaaagtgacttcatatctctgggcctcacacaatggaaatagtgggatctaattgggtcattgccaggattgaatgaggtaatgtatgcaaagggcctggaagagcagctgacacataataagtgctcggtaaatttagagcatttttggccattttcagccaactctatttacctaatgctattctttggaagtttgaaaagccactctgttgggaggccaaggtgggaggatcacttgataccaggagttggagaccagtctgggcaatagaggcagaccccatctctataaaatataaaaaattaaacagatgtggtggcatgcacctgcagtcccaactacttgggaggctgaggcaggagggtcactggagcccaggatgtctaggctatgatgagctatgattgcaccactgcacttcagcctgggcgacagagcaaggctttgtctcaaaaaataaaataaaaaataaagaaaaagaaaaggcactttgggccgttagaattgaagggagagcagagtttcaaagctttggatgcagcgggatgtggtggctcatgcctgtagtcccagcactttgggaggccaaggtgggaggatccacttgagccccggagttcaagaccagcctgcgcaacatagtgagacctcaccttttaaaaataaataaaaatgttagaaagcttttgaggcatcttccaggccagcaacttatccattcagaaccagcatcctctttttcataacgacattttgtaatactttctagcagatgctatagtgattctgcatatagggactcaacaacttacccattaaaatagacatcgtagacattgtcctattacaaattaacctgctcttagtcctcttttatattaccatcagggcataatattgatttttttaatgatgggtttaagtgatcctgttgtatgacatatgaggtaggccagcacttctcaaaatctaatgtgtatgtgaatccccagggatcttgttaaaacacaaattgtaattccgtagggctaaggactcagtggagcctgagattctgcatttgcaacgagctcccagatgaggctgatactactggtccagggaccacattttgagtaatgagactctggaggacatagtgaagtaattctgatatgtacaccatacacaaaatcaccatgaagtgacaggcacaaatgatggctaactctgggttgtgtggacaattcaaaccacatgaggggagttgccagcagtgtcaagatgttccacaatgttgaacacctcttggcaaagttccatatacaaaagagtctagtctttcttccatttatttaatagttgcattgcaggaaaatgcaatgtatattaaaaacatacaaaaaatatgttgtgttcttatgtaaaagagttaggtttaaactaaaagcacaggatcaggtgcagtggctcccacctgtaatcccagtgcattgggaggctgaggaaggagaatcgcttgaggccaggagttcgagaccaacctgggcgacataaggagacctcgatctctacaaaagaagttttttaattagccaggtgtggcggcaggtgcctgtagttctagctacttggaaggctgaagcaggaggattgcttgagcccaggagttcaagattacagtgagctatgattatgccattgcattccaacctgggcaacagaacaagtccttgtctcaaaaaaaaaaaaaagaaagaaagaaagaaaaaacccaaacaaacaagcaaactaaaagcacaggtaattacaagcaagatttttcacctctttgagggacattagaaagtcatgaagaggaaaagataagtctttcccatatgggactgtcatgtacatggtagggtatttagtataactgcctaccattctctaagtgcctgcagtgcccctcaatcattatgttattaggtttccacgtagttctacaacagttttctgaaaaccattgttctaggtcattctttcgcttcaatcttctcctatgggtttatgcattcattcagttagtatttactaagtgcctactatattctaagctcatgctgtgagttcagtcacacaactgcaagtgaagtggtctgagacattctgagaaatacgaccaagaaactgctcccagggtctcagggcaggtttccagaggagcaatctgagaagggagtagagtgtttcagtctaacaacagcatgtgcaaaggccctggggtggaccagaaggaggccagtttgcaggacatgactagtgacgagaaagtgacaaagaaattgaaggtgcattgatgagactctggggctgtcagtcactcaggggaatgagagatcaaaacgggagtttaggtggaataaagtgtttaccacagcactctctgtatagtaaagaccaatgaagagccaggtacaggccagtgtgatggttcacgcctgtaatcccagcactttgggaggcagagacaggtggatcacctgaggtcaggggttcagaaccagcttggccaacatggcaaaaccctgtctctactaaaaatacaaaaaattagccaggcgtggtggtggacgcctataatcccagctactcaggaggctgaggcacaagaattgtcctgcgaggcagaggttacagtgagctgagatcacaccactgcactccagcctgggcaacagaacaagactctgtctcaaaaaaaaaaaaaaaaaaaaaaagccaggtacagtggtatgcacctgtaatcccagctactcaggaggctgaggcaaaggattgcttgagcccaggagttcgagaccagcctgagcatttagagaatgggaggccagtatactaaataccctaccatgtacaagacagtctcatatggaaaagaattatcctttcctcttcatgactttctagtgctcctcacacaggtgaaaaatcttgcttataattatctgtgcctttagtttgttggtttatttagggttttgtttgttttttttttttttttgaggcagggtcttgctctgttgcccaggttggattgcagtagcattgctcattttagagatgagcaagacctcatgtctaaaaaaaaaagaaagaccaatgattattaattactcttgctattattactaatattactgttattatcagccttattaacagatctactgttattgaaggaggcagagtgacagggacaaaatgtctctccctaacaatatgccaggaagagtttttgaaagacaacagtaaacattggaaactacaagagcagcaaagcctggttgtgaaaggcaaggactttggggcaggcagtcacattcctgccctatcacttccaggctgtgtgactttcagaatttcactcctctctgggcctccatttcctcatctataaaatgaagataagaatagtagctacctccttctctgggtataagatttaactgagccgggcgcggtggctcatgcctgtaatcccagcactttgggaggccgaggtgagcggatcacaaggtcatgagttcaagaccatcctggctaatatggtgaaaccccatctctactaaaaataccaaaaaaaaaaaaaattagccgggcgtaggtggtgcacgcctgtagtcccagctactcgggaggctgaggtaggagaatggtgtaaaacccgggaggcggagcttgcagtgagccgagatcgcaccactgcactccagccggggagacagagcgagactccatctcaaaaaaaaaaaaaaaaaaaaaaaagatttaactgagttagtacgtgtaaaatgctttgagtggttcctggcttataccaagagctcaataaatgttagcaattttttgtagcattttggggtctcactatgttgcccaggctggtgtcaaactcctggcctcaagaaattctcccactttggcctcccaaagtgctggatttacagacatgagacaccatgcctggccatgttagctattattaatatgaatattattaagtactcaatgaatgctatttttagcagtaatagtaagcactcaggaagtgtcagctaatactgttagtaatactctcatcaataaacataaaaagcaataaggacccagcttgcccaaatcccacagatggttcctgctccctctcttcttcagaggaagaaactatctccccactttcacccccatagcctcagctggccagacccccattctgaaccaggggagtactgctaattccattattaatagacacatcaaacaatctggccgggagagacattattcatttggctgataaagaggttctaaggctctttggaaataaaagttcatgaagattcatgcactttaagagaaaaaaattcaagatcagtcattcatctgctttaaaaaaagtggcaaagataaaactttatttgagaatataaaataataaaaagacattttcgttctctgttgtgacaaagccagtggccttcggaggtctgccttgtacatttttcctcttcttcagtcattccttgaggctttttgcaaacgtaccctgtgtttttcattctccagcatattgataattttttttttttgagacatggtctcgctttgtcatccaggccccggagtacagtggtacaatcatggctcactgcagccttgacttcctgagctcaggtgattctcccacctcagcctcccgagcagctgggactacaggtgtgcatgaccatgcctagctaatcttttgtattttttgtagacacagggttttgccacattgccaaggctggtctccaactcctgggttcaagcgatcctcccacctcagcctcccaaagtgctgggattacaggagcgagctaccttgccaggccgatcatatttttttcctttttattcactttgtcttctcctcattcctaccttcatctgtctttcagtggctcactccagtgaaaagtggactgacgcacattctatttcatataattcaatggctgctggccccagatcccccataccaggtggccgagcccagtggccctgcagggtggacaaaatgagggtggaactttcccagactgtcagtaaaaatctatggaggacagagcttctgcctctcccttgcaaccaggcagtgccttctcccaggcctatctgcttgcaaagggaacttttgccaagacctgctccactctagaattcttatctctgctgttcgcatcctaattccacctgcatctgtcaccatgacaacctgctccccaaaaggaacaggaagagagatgctggacttttgagctccacagtttatcctgcatgggggtagggagtggttaattacttagcactctaattcttacggtacccccaatgggcccaagttggtttttttaaaaaaaaacagtcttgctctgttacccaggctggagtgcagtggcacaatcatagctcactgtagcctcaaactcctggactcaaatgatcttcccacctcagcctcccaagtaactggaacaacagtctcgtgcaactacgcccagctaattttttttttttttttttttttttagagatggggtctcactatgttccccagactgatctcaaactcctgggctcaagcgatcttccttcctcagcctcccaaagtgctaggattacaggcgtaagccactgtaccaagctgccccattaaagctttgaacaccagagagcccagctcagctgttttccagctgggtaactctgggtaactttgcctctctgaacctcagtctcctcctgtgtgaaatggggctgatcactatacccatctcggatggtggtagttgcagggattaaatgagttaatacgtgaggtccttaggacagggggtggggacacgagataagcaataaacaggaactgctgttattatcacccccacataatccgatctcagggtctgagtgtgccccaggcaaggtgtccacagccctctgcagaaggatgcccaagtgatcagctggcacaagaacgccacgcacagcaggtgttatgcaactggccacctattccaggcagaggatgccagatccccagggagaagggggtaggggtgcagcttcaaagttttctgccccttttgagttctccttggagacactttggaaatgaaacctcccggaaattgatattaggcctctgcaggctgagcttgttaaaatttcccaacaaacagagccaacagacgctctacaaggaagcaaaaacaagacaaaacacattggcagacccttttccatctgctcttggtagatggtattcctctaagaaaatgccgccacgagtttctccatggcttcttgagctggtggccaaaggatttaggttctctttgaaattataacttaactgggcctgctttatggcagggatatcactctctgaaatgtgtatatatatgtgtatgtatatatatacacatatatacacatatacatacacagggccaggcgtggtggctcacacctgtaatcccagcactttgggcggccaaggcaggtggatctcttgagccccaggagttcaataccagcctgaacaacatagtgagaccctgtctctacaaaaattaataaaaataaccaggcatggcagtgtgtgcctgcaatcccagctacccagggtgggaagatcgcttgagcccaggagttaaaagttgcagtgagctatggtcataccactgcacttcagcctgggcaacagagcaagaccctgtctcttaaaaatatattattattattatacacacacagacacacacagacacacacacacattacagatgatgagaaaatactctcagccaggttttcatgatacacaacttctcaaaaagcatcacaagcaggttagaattagggatttctttgtggactgtccaagatgttgaggaaatattggtttagaatttacctcatttaggccagaaatggtggctcacgcctgtaatcctaacactttgggaggccaaggccaatggatctcttgaagccaggagttttagcctggccaacatggcaaaatcctgtctctactaaaactacagaaaaaaaaaaaaaaattagccgggtgtggtggcacaggcctgtagtcccagctactctggaggctgaggcaggagaatcacttgaacctgggaggcagaggttgcagtgagccgagatcgtgcattacacttcagcctgggtgacagagcaagactccatctcaaaaaataagatagataagataaatatatataatatatatgttatatatataatatagaaactacagaacaagtgatctttgtatgtttccagaatataacagcgggacaggcataggatagacgttcccattgcaaaagggagaaattggaagggataaagaggtcaccagtcctaagcaagtgctaaatccagcaagacaaatcccattaggtttcaaggcctgagaataatcctcggtgactctcagctcattaacatacttagttctcagagccagactcaatgaggttacggcccgcatgttatgggtcaggaactgaggctaagtaactcactggagattatgtggtaaagaaggtccaggatcattgcttcagtctccaggatatggggaaggttctactcctgttatcccaaattttaaaatgtgggaactaaggctcagagaggttaagcaaatcacacagggttgcacagctagtgatgttgctgagatttccctgtgtgtagtggctcatgcctataatcccagcattttgggaggctgaggcaagagggtcgcttgatcccaggagtttgagaccagcctgggcaatatagtgagacctcatctctacaaaaagaaaaattaaaaagttagccaggcgtggtggcaggcacctgaagtcccagctactgggaaggctgaggtgggaggattgcctgagcctgggaggtggcgattacagtgagctgagatcgcgccactgcactacaacctgggcgacagagtgagaccctgtctcaaaaaaaaaaaaaaaaaaagacattgccgagattcaaacccaggtcagcctgtcttctgaaatgtccctctatgacccactcacaaaactgagaaggcagaaagttgcttggacctgtctatttcccctgtgcagtctcagagaaacagtggaactgcctcggtttctccttccgggaagtattcatagaagcatcccacttacctactttggtctgaaaataaattagcttgtctctcttccacttactaaaaacaccgtgggtttttgcaagttaaaatgcaaaaataaaatgaggagaatggtgctggtagtttagccagtgggaagccctctggggaaagccagccttttatttattacttatttatttatttattctttctagatagatttatgggaaaccagggctgtgttgtccaggggtctgtagtccagaaggcatcagatgggctactaagtgagtctttgtccacctgtagatggcaagaggcagggcccaggtgtccatggcttggagaggcaggggttgatgggaggtttgaggctgtgggatctctcctggggcctcagtatcctcatctggataatggggacattctggccaggcacggtggctctatatatccagcacttagggaggcctataatcccagcactttgggaggctgaggtgggtggatcactgtaggccacgagttcaagcagcctgggcaacatggcgaagccctgtctctactgaaaatagaaaaactagctgggtattgtggtgcacgctggtaatcccagctattcgggaggctgaggcacgaggatcacttgaatccacgaggcagaggttgcagtgagccaagatcctgccactgcactccagcctgggcaacagagtgaggctctgtctcagttaaaaaaaaaaagaaaaaagaaaaagaaagaaagaaaaagaaaatgggggtattcatttatcatttgacagtaagtttacccagcattgactgtgtgagaggccctgtactaggcagtgaaaactcagctaagaataagaaagttaaaaacaagctgggcattgtggtttacgcctgtaatcccaacattttaggaggccgaggaggaagaatcacttgaggccaggagtttgagaccaccctgggcaacatagtgagacgccagtctctacaaaaaattgtaaaattagccagacatggtggcgtgagcctgtagcctcagctacctggaggctgagatgggaggatcactggagcccagaagttcaaggctgcagtaagctatgatcctgccactgctctccagcctgggcaacagagtaagaccctgtctgaaaaaaaaaaaaaaaaagaggccaggtgcagtggctcacacctgtaatctcagcactttgggaggctgaggtgggtggatcacttgaggtcaggaattcgagaccagcctggccaaaatggtgaaaccccatctctactgaaatacaaaaaattagccggtcgtagtggtgggcacctgtaatcccagctactcaggaggctgaggcaagagaatcgcttgaacctgggagccagaggttgcagtgagccgagatcacgccactgtacgacagagcaagaaaaaagaaagaaagaaagaaaagaaataagatgatggggagttgtggaaacctgtccatgggcacgtgaaggtcttgacctctgaccaagaagtgaacaggctcctctcaattccaggcactgcagggatctgggacatgacttctccatgaccaaactgtaccctttccttttcttttttgtttttttggtgacagggtctcactctgtcacccagactggagtgcagtggggcgatcacggctcactgcagcctcaacctcccaggctcaagcaatcctcccacttcggcctcccaagtagctagaactacaggcacacagcgccacgcccgtcaatttacacattttttgtagaaatagggtctcactatgttgcccaagctggtcttgaactcctggccttaagcaatcctcctgcctccgcttcccaaagtgctgggattacaggcgtgagccactgcgcccagcccaaattgtactcttgaaagatggaatcttagctaggatcctgaactgttgccttttatcctaaatcagttgttggttctttttcattcacttgccttcctcagagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaaggtgagaccctctgctctcacatcactgggcaggggacctggcgtccctggagccagaggctctgctgagtgaccctggactgtgaccccatctctctggcctcagtctcctcccctggaaaatgggcataggcgtagtttcctaccccacagggctgtggagggttcagtgagataatttgtgcacagtgcctggcacggggttgtgttcagtcgggttagcaatatcttctacgtccttccttcccaaggggagccaggaagccaccccatttgaggagcaatagggtcctctgatggaagcttgagggggtcagatgattgattctctcggcccagcactgtccaaaagaaatgtaacacaggccacatgcaaatgtcagtttaaactctctagtcgccacattaaaaaaggggccagatgtactggctcatgcctgtaatcccagtacttcaggaggccgaggtagagtgagccaagatggcacctctgtactgcagcctgggtgacaaagcgagactgtctcaaaaaaaaaaaaaaaaaaaaaaaatggtgaactgctgggtggattatgtcttaagttcatctagtgtcagttctatgtgagagattttcatgagtttgctggataaaggctttccatggtcctgagacctaagatcctaaggtcttgtcactgtgcccattttatagatgtagggactgaggctcagagaggctcagcctgcccgtgggcacataagcaggctgggctgcagaatggaagctccagaggctgatggctcctccccctgagtcaagagaggggtgctaatgggggcatgccatgcagtttatgggaggtctcagtatttctatctgttcagtgggtctcttggcactctccctacctgcctgcaagtgagggtgtgaaggtccaacgaggataggggcaggtctgtgttaatatcccatgagggccccaccgcactcaaggctatagagtggttgagagcaggctctcgggggccaggccgcctgggttccaaatgccagctctgccacttcctgctgtgtgaccttagacaagtcactttacttctctgtgcctcaatttcctcatctgtaaacaggagatcagaatatatcaacctcagggctatacaagggttcagtgatgtcataagatgcctggtatatacagcaggcactttagaaatgtcagccgcttcttgcctgccctgggagtacacaggagttcccagagacttgtgggaaattgtggagggagccctgtgttggttcttgtcccaacagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccgtgagtatggcccccagcaagggcagggggggcctggggctcccaccagggtggcggaagtcaggccagatagagggcaatgagtgagtgttgaccaccatgagtccagggatacctttgaacaagttgaaaatggatgctccttccgtaagtcaggtaagatgatttgtcacaatatactttgttggaagagacccctgtcctgccatccactagaaaatcattgttatttatgacaataaataaacaaatttgtcataaataaacaaataaatttgtcctaaacaacaaataaatttgtcataaataaacaaatcttcactgtgatgtaagaggcacccccttagaaatggctgccttgtgcagtacacagcctgaacaactgcacgtggcagccctaggacctgaactctgtttctaacctagactctgtaagggtttagattctgggcggatagtgtctgagttccatggccttctgtcttgggcatctttgaaatggatagactatttaggggagaaatttatcccatgaatgtcgtagtggctcggaggttgttttagaattgaatgtctcccagggatatttcttgaaagcctgaccgctcaaaatgcttcttgacaatgaaggatcatgtcagataagatgggggagaagctgctttctataatctgcctcttggcaactcaccctgggtagtaataaataaaagtacctttaaagtacttttttatttagttgacttatcgattttactaaggaaacacttatgtggtatctactcagtgccaggcactgttctgagtgccttaaaattttttttaatttctctgaggttgttactatgcttagctccatttgacagatgaaaaaactgaggtccagagacgtgaattcacctgcccaaggtcacacagcaagccagtgggagagctggagtttgagcccagacactggctctagcctccttgttcttaaccactcagctctgctgccattcacacaaccttatgaactatttattattggctccacttattaagaggttaactggcacatcccattggcacattcaaggctctgataaggcctgcaattcataatttcaataactaactttttggagcccctatcatgagccaggcataaattaagtcttgggtctcatgattttgtgaagtaagcactagtattacggctattttacagatgagggcaccaaggcacagaggggacaagtaacttgcccaaggtcacacagctaatttttaaaaagaaagaaagaaatctacttaacccatagattcacaatattgtttggccctgggacatttaatatcgaaaagcctttttatctcctacagaattaaggaccgtatttcttcaacctagcttggggatcaagatacttcaagagggtcgtttgggagtgataggaactttgctaaacagggcatgtgaatgtcttctctcaccgaggtcccctctgccttcttggggttccaggacccagagagggcccccacctggaggagtttaatagtttgttgtgtaggaggccttgggggttggagatctcagtagtggtaggtaacatgagattatggaagaaaagggtttgtgagcctgtggtctgagtggacctctgcacgcccatctgtctccaacagccttcgccgcctgtgccattacatcctgaacctgcgctactttgagatgtgcatcctcatggtcattgccatgagcagcatcgccctggccgccgaggaccctgtgcagcccaacgcacctcggaacaacgtgagtcccacagagcacaccccttcctagcctggctgctctgcctcaggccactttctcctgcatccaaaatgctcataggtagggtgggatgttggggtcacccctaggcatagcccttatggctgctggttgagaggggaagctctgattccttggggatgctcttgggagcaagacattccttgaggcagtttctctgtgagcctggtggggtggaggtggcccagagtgactggggctgaaaattgctggattctctaatggaggcgtgagactagcaggatatggatgttgcacattctctacatggaataggggggttactggggcaggggcggtgctcagaggtggtcccctccgcagtagacatttccctttgtacacgaagctttgaaagaaacaactatttggctcagaaacacagcctaagcttttggtttttatgaaagcaagcccctttgcggatggtgggtctgttgacaacccctgttaattgagcacttgctgtgtcccaggaagaaactcagcatgcagtatctcatttaatcctcacaatgcgcccccccaaccccccgcccaggcatccccatttgacagatgggaaaactgaggctcaggggaatgagagagtggtaagtggcctgtccagggtcacacagcagaattccaactctgcatcccccaaagctcccactgcttcccccaactgtctgcatttactaatcacctactgtatgctacggatgggtgtgcatagcccctttgagtcctgacaagcaggaatgagtgcatgcttgtggttgagatggggaaaccgaggcaccaacaggcaagggcgtgcctcagtcatgggctgcgggcagaggcttgaccccagggcctggtagagggtggactggtggctcctgtttccctccccagctccctcccccaacccttccctcccaacccagagccaaaaaagtgtgttttctgctggtccaaggctctgctgccctggctaagtaggttaggacccaggcaaagctggcgagccccatccctcaagcccgcccacagcttaccatgcactttcccttccttcccaggcctggcaggcccccctggggacctgatgggggagatggaaggaaataattagaacgcagctcctggaggaagctagagccagtgctcagcctcctcacagtccgcttagttgcttcccgcagcctggtttcccccaggggcctccaggagccaggcgtggggaggaggtgtccctggaggggtccacaaaccccctgctgacgcgaggatgctgaagaaggcgttgccttcggcagggagggcacaggcatggatgatccagggggcacggcagctcccagggctgaagggaatctaggcagtgctcagaccaggccccagggactgtttgcaaagagcgttcagctccccggccccctccctcgtccatctcgcagtcgaaacttctctacaagaacactgtggccccataacgttcacaccacgtaaccaccatccagggcaagaaatagaacaaaaacgccccacgcggcatgtgcctcctcgatcccccacccccaccgccttctttccctctagagctgctggggacactgtctggagacatttttggttgtcacgacaggaggggggaggtgctcctggcatctggtgggtggaggccagggatgttgctcagcacccgccgatgcccaggacagcccccactctagaggatgatccagacccaaatgtccacagagcccagcttgagaaaccctgccttaccggtaaccacgaccccagcttctggaatgagcgtttttggcttctctctttttcccacctgcacaggctttttttttttttttttttaagagacaatgtctctctctgtcgcccaggttggggtgcagtaacgtgatcatggctcactgcagcctcaacgtcccgggctcaagtgatcctcccacctcagccccccaggtagctaggaccacaggcatgcaccaccacacccagctaatttttaaatgcttgtagaaacgggcctcgctatgttgccaggctggtctcgaactcttgacctcaagcaatcctccctcctcagattcccagagctctggaattacaggcatgtaattccaattcttacatgcctgtaattggccaacactggccaattcttaaaaactgaatttatgtttgctcttctgtaacattcaataaatgagacacttctatgcttcgcattaaatgagtacatgttgcttttgcaggattgatgggcattcttttttttttttttttttttgagatggagtcttgctctgtcacccaggctggagtgcagtggtgcaatcttggctcactgcaacctccgcctcccgggtttaagcgattctcctgcctcagcctccagagtagctgggactacaggcaggcgccaccacacccggctaatttttgtatttttagtagagacggggtttcacactatcagccagactggtctcaaactcctgacctcaagtgatccgcccgccttggcctcccaaagtgctgggattacaggcgtgagccaccacgcccggtcaatgagcattctttatgatgctgttttgagatttactgtgtggcatgggatgtgttatccatcccctgttgacagatgtttgggttgtttctaagtgtgaatactgtccccatgccacgcccctcaacatgtttcctgagtcacctggacagtaatttctccaggaggccagatgcagtggctcacgcctataatcccagcacttcgagaggccaaggtgggagcaatgcttgaggccaggagttcaagaccagcttgggcaacatagtgagacccccacctctaccaaaaaaaaaaaaaatttttttttttttaattaaccgagcgtggtggtgcacacctgtggtcccagccacttgggaggctgaggtgggaggatcacttgggtctggaaggtcaaggctgtagtgatccatgttcataccactgcactccaacctgggtgacagagcgagaccctgtctcaataaataagaattcctccagggtataaaccaaaagcgaagtttctagagcatataatttgcaagtggttggcctcagtaaatgcagcttgaatgtttattggacaataaacacagtgaccctttgggaggccaaggcgggtggatcacctgaggtcaggagtttgagaccagcctggccaacatggtgaaaccccgtctctaccaaaaatacaaaaattatctgggcgtggtaacacacaactgtaatcccagctactcgggaggctgaagcacaagaatcacttgaacccaggaggtggaggttgcagtgagccaagatggcgtcactgcactctagccttggcgacagagcgagaccctgtctccaaaatatatataaataaataaaaataaacacagtgggccgggcacagtgggccgggctcgcacctgtaatcccagcactttgggaggccaaggtgggtagatcacgtgaggtcaggagttcgagaccagactggccaatatggtaaaacctggtctctactaaaaatacaaaaattagccgggcgtggtagcatgcgcctgtaatcccagacacttggaggctgaggcagaagaattgcttgaacccgggaggcagaggttccagtgagccaagattgtgccactgcactccagcctgggtgacagagtgagacaccatctcaaaaaaaaattaaaaaataaatgaacgcagtggcccttgcaccagtagctcatgggaactcctgttcttccacatccttgtcaacacttggtactgtcgactgtttcatttggccgatctgctgggtgtggagtgagatcttattggggttgtgcttggcatttccctgtaatgaatgagatcaagcacttttttggattagactgagccacaggaaataacattttcaaatagatgaaaaagatctaagtattaggaatacttgaacctaatttattggtcttttgatttcctcttgcacagcttattaagagctccagaattagattcacctgacccccacggcctgccctttcccagctccctctcttccttctttccttccattcattcctttagtaagtatttgataagcaactactatgtgccaggtactgagcgagccagggaggattgacagggtatgagatggtccctgcactcccagagcccacaaaccaccaggcctttgaccaggctgtgcccactgcctcgtgcacctgaaatactctcccaccaccatcccctctgcccacccaggtctttcaagccaatccccttgcaccagcccctccctccaggaagtcacctcaccctgaccccaggcactctggtctctgattcctcttcaagcaccacatataacaggaatataagttataaccacacagatcacagagcccagctcctccaggacccagtacagccccaactgttgatgcattcattcaacaaacatttcttgagcacctactgtattcctgaccctgtattataagctggagacgccatggtgacagacagacatccctgtccttgtggggctgacatttgggtgggggagatggacaatgagattatcagtaactacaacaaatgttcagggagtgataagtggccgggggtgtggtgggcagagggaaggagagacttcgtaaagaggatctcaagcaccaggagatggaatttaaacagccggtcaggggagtcctcactgggaaagtgttatttgagctaagtcataaaggaggagaaagacggaatcaaatgggatgtgggggaaagcattccagagagacagaacagcctgtgcaaaggccctgaggtggaagcatcttggggaacaaaaggaagtgagcaagggagagaatgagaggaagtgagggcagggagctgaatggtcagatcgtgcaggggcttgagggcctcggggaggactttgacttttatccctgaatgaggtgggagccacggaggattgtaagcaggggaaggatgtgcctgacttctttggtgttcacagcgccctctggtggccatgttcagtaatgctcagcccttgcagcttctgggtggatctgattttttttttttttttttttttagacagtctctgtctcccaggctggagtgcagtggcacgatctcggctcactgcaacctccgcctcccacgttcaagtgactgtcacgccttggcctcccaagtagctggaattacaggcacacgccaccatgcccagctaattttttatatttttagtagacacggggttttgccatttggttaggctggtctcgaactcctgacctcaagtgatctgcctgcctcagcctcccaaagtgctgggattacaggctcgagccaccgtgcccagccggtgtccaccccatgtctagcaccagccagacactgtgccggcgcaccctcatcttcaggcctgggtgacaccagaggtgtgctatggtgtgtcctggacaggggctgggccagaggacattgctcgtccaggcagaaacatcaggcctggggaggggcacaggaaaaatcaacctaccctggcaggggcctggccttgaagcaggaagagatgccgtggcaggaagttggccccagtgtttaaaaaaaccacgtagcaactatttctcgcccaggatgcccaggaaagcaagggtactgggggattagatccatcaccaagaaggatacagtcagccctgaacttctctggggccgcttctaatccactacagggcttggggcaaattttaaaaggtacccttcccgtgggttagcgaactggcctagtacagtgatttttttgttaggatttgctgccatctgctggacaatttcattcacaacatacaaatctgcagtatgaaaagagatgggaggggcccttgtgcagtgcacgccctgcgcaactgtatatagcagctgtgtttcctcttctgggtagaaactctgctccccagtaggcgatcgttagttttaccggggctctgctggaacaggccagtgatccactgctctcttgcttttatcccttacaggtgctgcgatactttgactacgtttttacaggcgtctttacctttgagatggtgatcaaggtgagtgcagattataagtgagaacacacggtaatttttttttttaagcaagtgcagggctgggcacagtggatcatgcctgtaatcccagcactttgggaggctgaggcaggcagatcacttgagatcaggaggttgaggccagcctggccaacatggtgaaaccccatctctactaaaaatacaaaaattagccgggcatggtggcacatgtctgtaatcccagctactcgggaggctgaggcaggagaatcacttgaaccctaggctgcaatgagccgatgtggaggctgcagtgagccgagatcttgccactgcattccagcctgggtgacacagcgagactctgtcaaaaaaaaaaaaaaaaaaaagagctgggattccaggagatcctgagcctccaagaatgccccccttgagaggatgagtctcccagaggattagaaatgcctggtgtgtttgaagagcagcaaggaagctggtgtggctgggcggagtgagagaacagtggggaaacgaaggacagagagatgagtggggaggtgagggggcaccttgtgccggggatcacagagagggctcttcggctcttactttgagtgaggtgagggccatagagtgttctgagcagaggagggacttgatccaggtgttcacaggtgccctttggcatctgtgggaagccagaggacctgtgagcaggtgatcacactggtccccatgggcgatgacggggacaggatcaggctggtgaccaaagaagaggtgagaagtggacagattcttggaaggttctggaaatagagccagtgagttttgctgatagagccaccaatgagggatttgggacaaagaggcatcaaagaggatcccaaagtttggatctaagagccggcaagccagagctggcttccatcaggcaaaggggggccgcctcatggggcaggggctccccactcctccctggagtcctctggccactgcccatccctgcaagatgaggtggcctcattggcttccctgcctctccccgagaggctagagagtgggtggcagcaccccagggtggggatcaggtgggggttctgagcaccctctcttctcccccacagatgattgacctggggctcgtcctgcatcagggtgcctacttccgtgacctctggaatattctcgacttcatagtggtcagtggggccctggtagcctttgccttcacgtaagtctcctcgcaagggttcctcttgcctcttttcccccaacccccagcctgggccacacatcggattacaggacatgttctcagggtctagggatggggtgtgtgggctccggggacgtgggagatatcagcatgccaccaggaagagcttcgatggctttttgcatgatgtccatggaggaagaaggagaagggaccccccctcctgccaaccttctacctcctcacacagcaacgggcctcagccacatcactggccccttgctgtgcagcttcctgtagactagcctcgccggaacatctcatccccctactactccacaagcgccgcccaaaccgctgtctctttggaaagtccctaaagagacaatcaggaaacgaatgtgcatgagaattctgaccccctccctatgcctgaaggccccgtagttgtagacctggtgactccctttgtgtgtctttcacttctcctggcagtcctaggattctctgccctctgaaaggccatgtgtcatcctgcagctccaagatggcgccccagttgtaggcagccatttcaggatggcacccaagctcttagtagtcatcccaagatggcatccaagttctgggtggccattccaagatggcccctgagttctgagctatcattccaagatggcctctgaatttggggtggtcattcttagatggtccctgagttccaaggtgaccttcaagttctgggtagccattccaggatggtccccaagctctgggtggctattccaagatggccccaagttctaggcagccattgcaagatggcccctgagttccagggtggcccccaagttctgggcaaccattccaaggtggcatccaagttctgggtggctattccaagatggcctctgatttctgggctaccatgctaagatggcctctggattcttggtggccattcttacatggtccctgagttccaaggtggccttcaagttctgggtagccattccaagacggtccccaagtcttggatggctactcgaaggtgacccccaagttctgggcagccatctcaaggtggcaccctagttctgggtaaccattccaaaatggcacccaagttctagggcaaccatttcaaaatggcccccaagttctgggtgactatttcaagatggtacccaacaggtgagtggccattagcccttagggccctgatagcagacttagcagtacattcctgaagttgtagacatttggagcgggatgaaaaatatctaatcagtctttaatcaagaaacaaatcttggggaccctggctgtgcccatcatggtgaatgattccctgacaggttttgaaaggatcttgacacattcactcccatcgtgagagaatcaggggcttcctcctgtgcctctgcctctaggctccctcctgagccaatctggaggggcccttgaatggtctccctcaccaaacaatgaggacttggtttgtcaggagggccaaaatagtggcccatttccagtagaagggctgttaagtaggccacacttagattcttctctgggaacacaatgaggtcaagttgtgttagaacaaaaaatctccagagtttttggatgcctcagagctggagatgtatcatgaaggttgggaggctgattatacttctttctctttctctttcactccttcctcctctttctcctctctttttgttcgtttactcttttctttttctcttctcctctccctccccacatccttccctctcctcaaagcttttcagtgtctatttgactactagagcaatgcacggtggcttacacctgcaatcccagcactttgggaggctgagacaggcagattgcttgagcccaggaggccaagaccagcctgggtaacatagggagaccccatctctaaaaaaaaaaaaaaacaattagccaggcatggtagtatgcctgcactagcagctacacgggaggctgaggtgggagaattgcttgagcccaggaggttcaaggctgcagtgagccgaaatcgcaccactgcaccccagtctggggaacacaggaagaacttgtctcaaaaaaataaaaagtttaaaaaattaaaaatcaatgaatttgctatttagaatattatgctttatatggttactgaataattttaatagtgatgagtacaaaaaaaacaggtttagcaagctgttctgtaggttaaaaagtaaataaataaataattaattaaacaaaatacaatgcacatcaaattaggggacaaagattgtgacgaataagacaaggagtccatgtctttaaaatatgaaaagcagttacaaatcaataagaaacactacttctcaatggataaatgggcaaaggacataaacagaaatctgatagaatgctggcaactagtaaaaatggaggtaaatcaacccttggaattcagagaaatgtaaaataaaaacgagatacaattcattccctatcaagttagcactgttcccgccgcacccccacacacacacaaaaaatgatttttttagctaataaacagcatatataagaatgtattataataggctgggcacagtggctcacgcctgtaaccctagcattttgggaggccaagggagggggatcacctgaggtcagcagttcgagaccagcctggccgacatgacaaaaccctgtctctactaaaaaatacaaaaattagccaggcatggtggcggatgcctgtaatcccagctactcaggtgggtaaggcaggagaattgcttggacccaggagatggagactgcagtgagccgagatcatgccactgcactccagcctgggtgagaaagcaagattttgtctcaaaaataaaaaaaggaatgtattataataaaatatacttttctccccctctatcacctatttaagcaggtccttcaagttgtcaggtagacatcatgctatgagaaaatttaaatcctgaaaagccagaatgttttaccaccctcagcctggaatgaatccttctcctatggaaataacctacgggtttctccacccctctctgcctttcagccccttccctccctctcccctccttttctttctccctctttctcttcctcctttcccctctcttccctctctcttcttccctctctctgtctctttctgttcgtctttctccttttaccccctctcagtttctatctttttattttcctctttctctctctctctccctctctttctctctcactccctgcactgttgatgacctatgtccttgggtgatgtgggcctcccctggaccgtgtagcttggagaaagctgaccctctgtcatcggtctggcaacagggacttggcccccctaccctgcattctgatgaggaatggtattcagacaaaggcagatcccaggacacaggaggacatgctcaggcagggacccccgcccctttcctctggggcaaggtctgctcagcagcctccaagattcctagggctcaagaggtggcaggtagctcagggcactagggcaggcagtggggtgaatatgtcactcatatccacctgtccacacacaatgcttaccttggccacctgtgcccaggggaatgggttttatcctgtgaatcctcccagtgaccaccactgagtgtggcacagataaatggtaccaagcccaagctgttcaggtctccaatgtcactttcctctcagacctctgttgtagctgacatactgtaatgctgaggagggccgggcacagtggctcatgcctgtaatcctagctctttcggaggccaaggcagatggatcacctggggtcaggagttcaagaccagcctgggcaacatggtgaaaccccaggcaacatggtaaaaccctgtctctactaaaaatacaaatattagccaagcgtgatagcaggcgcctgtaatctcagctactcgggaggctgaggcagaagaattgcttgaacctgggaagtggaggttgcagtgagccaagattgcaccactgcactccagcctgggcaacagagcaagactctgtctcaaaaaaaaaaaaaaatgctgaggaggtgactgtcccacctccatcctccgagttgaccatcacaatttagggaggggaatgacctacaaaggacccagaagcaagcctttcaattgttgagcttttgccattatgggccatcgtttacaacatgctgtttctaggttctctggaggtaaaattagcctcctcttttaaacaaagctaatctgcaaaagcgaaccaaaaattcttttccaccagagatcaattagcagaatgagctgggtgcgatggctcacacctgtaatcccagcacttggggaggccgaggcaggtggatcacttgaggtcaggggtccaagaccagcatggccaacatggtgaaaccccatctctactaaaaatacaaaaactagctgggtgtggtggggagggcctgtagtcccagctactcgggagggtgaggcaggagaattgcttgaacccaggaggtgaaggttgcagtgagccaagattgtgccactgcactccagcctgggtgacggagcaagactccatctcaaaaaaaaaaaaaaaaaaaaaaaacagcagaatgattcttttggggagttgactttttttttaatttctgagttttctttttaaatatcaagttatacaagggcattcaaattggcctacaactcacaggaatttggcagcctgtttgcagagtcaagcttttacattgttctcatgaaattggtacaggcataaagccacccttcactcttgaaaatccattttgaatgttgttgttttaattcttatgcaagaaaaggatctggatagggatttcaggccatcctgtcaaccctggcaggcttgtagatcatgcaggaactgggaggtgtgagattttgccagtaggatcctggcaagtgcctgggactctcccagggttttggaagagccgacggacatgagtccaacagggagcatctttatatcatggccgaagggatgagagaggagaccctcaaacctcacgcctaccacaccctccccaccccactgtcaagagtccatctggtactgctgttcctcccccagggcagggctgcaggcccagcacagctggccaggtgccttgatcaagccattcctgcacacctaagagccaaactgctagaaaaccagaataggagctactgcttttttccctaaaaagttttggaatcttctccccgttacaggtttctggcctcttttgcctgagaaggtctctcaccctatgaggactttgcttattgtctttccttgttatcggatagttggcacattggaaggagcatggatgctctgaggttctcagcctgagcgctgaactctccacccgccccccaccccccaccccagggtcctctgcttatttcctttctggtcttttaacttgctttgtctgtcctctgtgcatatcccctcatagacaaggctgagagccccacaagtattagattgaccttattgttttaagaaattgtccctccaggtctgtttgatttctctctagatgtgcaagtcctttagcctctctgtgcctcagtttttcccatctagatgaggaaactgcggcccagagggactgtggagggaagtaagtccgacaagatcactgaggttgggttcagctgtcagatgctacccatctcccagccctgaatacggaggctcacagtgagcagaatgatgctcagcagcctggccagcctgggttctttgaggcctggcagggctgcgagatccaggggaagggaataggggaagggagcataaggttattcccttccttgttgaaaggaaccttgccattctggcctgttggggtcaaagcaaggattcttcccccagtgctgtgattgtggcctcgtctccgatatgggagaaaactatccctgtggtcccaccaagggatgtattgaagctcttctgaagatgtccacccctcctgcacctcacccaaatatctgtgtgtgtgtgtcctgctcaattcactgactgtgtcccttgtatccatgcgtctaccataaacaccccatttcatgagccatcacacgtggtatcacgctctgtgcccatgcatcagggcggccaactgacatttctcagcagctggcagatcatgatcctgccctcaccgccaagagtccatctggcgcggctgttcttcccccaaaggcaggaccgcaactggcagagcgccttgatcaagctgctcctgcatacccaggagccaaactgtcaggaagccaaagatggagccctcaggctgctatctcttgatcctcatcttcaaaacagcccccacccctgaaggcattatttttcttgtgtatgatgaaatggaaagaagattagagtgcgagatacccacacctgggtttgaatcttagtctgtcttcccagctgtgtgcctgcccttgggcaggtcactctttttctctaggcctcagcttcctcatctggaaaatggtcataatggtgctgtcttcccataggcaaatgcagtgatgtccagaagactcccatattaaacctaaagtcagcagattaggcaaaaatcactgtcattgaaaactccctcaatcatccgtaaagaagctgggtgtggtgtctctcacctgtagtcccagctacttgggaggctgaggtgggagaatcacttgagccagggagttcaaggctgcggtaagctatgattgtgctactgcactccagcctgggcgacagagcaagaccacgtctctaaaaatataaaataaagccgggtgcggtggcttacgcctgtaatcccagcactttggaaggctgaggcagcctggcaacagagtgagaatccatcaaaaaaaaaaaaaaaaaaaaaaaaagtagaatctatatgattctacgtatgcaataattcctagatacactgaatttgagaaccccaagtcagactacaggaaaaggagatgagggggtgtggaggagaatccacttggaatatttgtagacatttaaaccattctgtgttttaaaaaatatcacagccgggcgcggtggctcacacctgtaatcctagcactttgggaggccaaggtgggcggatcacgaggtcaagagatggagaccatcctggctaacacggtgaaaccccatctctactaaaaatacaaaaaaaattagctgggcgtggtggtgggcgcctgtagtcccagcactcgggaggctgaggaaggagaatggcgtgaacctgggaggcggagcttgcagtgagccgagatcttgccactgcactccagcctgggcgacagagcgagactccgtttcaaaaaaaaaaaaaaaaatcactaacttccagaggggtcgtggatggaaaattccatagagtccgcttggcgacagggtttccgccattctgatggcggtcaagtctttctaacctggatctccagtcattgttgaaggcgcctaatgagccccaagcctgattccaatgaatcacgagaggaccagctgctaggtgctgatagctttccccaggcccgcatttgctcagagggcttcagagttgcttctaattccatcccaagtcagaactctttgctgaccccctccttcataaagagcaaagccaaggccatagcttttgttaatcaaacatcagaattccacagacctgagttggttggttgtttgttttaagagacagagtcttgcccaggatgcagtggctcacacttgtaatcccagcgctctgggaggcctaggcaggaggatcacttgagcccaggagtttgagaccagcctgagcaacataatgagacccccgtctctacaaaaaatggaaaaatttgcctgtatttccagctacttgggaggctaaggtgggagaatcacctgagccctggaggttgaggctacagtgagccaagatcccgctactgcactgcagcctgggcaacagagggagaccctgcctcaaaaaaaaaggagagaaggagagagacagggtctccctatgttgtccaggctggtctcgaacttctggcctcaagcaatcttcccaactcgtcctcccaaggtgctgggattatagctgtgagccacggcacccagtctgggcctgttttgcagatgaggataacgagaggcagagtcaggattcaaacccaggtcccctcaacttcaaagctcacaaccttttagacattctaaaaccttgcagctccacaacgcctggagaagaggggtttctccggctcttggcagtgactttccgtggtgaattcacctttggtaactgacagctttgcagctgtcctgctacctggaaatttggctttcttagtgctttcttgggcagtgccaggtgcctgccaagggcgggggactgaatggaggtgggggcggcttccagatggaaggatggacatcggccagcgccatgagcctgaggctcccccaactgctgcccgggcgggactcgggggtgctcaggggtgcgtgtgtgtacgtgcgtgttctgtgttcttttttctgaggccacttacgatctgtctctccctccgatgccacatcaccaggagcagtacacggtaaagtctctctctatctttctctctctctctctttctctctctctctctctcatattctgtctctcgtgatctgtcccctggtgcagcctcgttagttctgggcctgtttctgtggccttgtgtccttgctgccgctgtcctgtcgcttcaaatgaccagaactcactccctgcgaaggaggcatcccaaagggtcttgccaatgcctccgcccatgccccaccagttcttgcagagaacagaaggggcagaggttcagtttcaataggcaagctgggtggagcagttatcagaagcaatgaaagtgggccagacacggtggctcacgcctctaatcccagcattttgggaggccgaggcgggtagatcacttgaggtcaggagtttcagaccagcctggtcaacatggtgaaaccccatctctactaaaaatgcaaaaaattatctgggcttggtggtgcacacctgtaatcccagctacataggaagctgaggcaggagaatcacttaaacctgggaggtggaggttgcagtgagctgagattgcaccactgcactccaccctgggtgacagagtgagactctgtctcaaaaaaatatataaaataaattgaacaataaaaaaataaaatggccatggaatcgttttcagatgaggagatgcagaatgcccatggagacatgctcccaattgtcacttgtttgggacatcaagattttagccagttccatgtgcaacctggatgtacagttccttgactttttttctatcaacatgtattctaaagttcaatttcaaaaggaaactttagccaggtgcagtggtgcatgcctgcagtcccagccatttgggaggctgagactgaaggatcacttgagcccaggagttggaggctgcggtgagctatgatcgtgccactgcactcccccctgagattccatctctttaatttaaataaaaaaaaaggaaactatattatccacttacaaccagcattgctaacctaagataaatctgcaactgcaaaagtaaatgtaggccagacatggtggctcacacctataatcccagcactttgggaggccgaggcaggtggatcacttgaggtcgggagttcgagaccagcctgaccaacatggagaaaccccgtctctactaaaaatacaaaattagccggacgtgatggcacatgcctgtaatcccagctactcgggaggctgaggcaaaagaatttcttgaacccgggaggcagagactgctgtgagctgagatcacgccattcactccagcctgggtaacaagagagaaatgccatctcaaaaaaaaaaaaaaaaagtaaatctaacagaaaccagacaatgttgttgccttcaagctgggctctttgttaaaaggaaaattactaagtgttagggaggtgttaaaggcctattagcatctacctgaggcttcctttctcgcaaaagcagagcgtctgaaagatacgtggaaaagaaacttaaagtataataaaaaagaaagaaagaaaaagaaatgattatgcccctctgagatccaattatttaatctgtgcccctgttctgcctaaaattatctcagtgactgtccaacgtgtgtctcacacttgggggcacagccttgagatgataatgatgatgttagttttaaaaagaaaaaaaaaggttcagagttctgaatcctggagtatatctctgcctagcaggctaaaatacaattatcgtctttgttccctgaaaaatgaaaaaaatggagtcctttaaaaagcaaatggtgtgaagaatgatgtttttgcactggatactgagacccatcgtgatgggggtctctggggcagctctgctcatgacctgggaggtcactgtagggagatgttttctaggtgacctccccacccaaatactccaaccggaggcattcacgtgtcctgagaccacacgccaggcgcaggctaggggctaggacaagaatcaagattaaaggggaaatggccaggtgcggtggctcatgcctgtaatcccagcactttgggagtcaaggccagtggattacttgaggtcgggagttcgagaccagcctggccaacacggtgaaaccctgtctctactgaaaatacaaaaattagccaggtgtggtgactcatgcctgtagtcccagctattcgggaggctgaggtgggagaatcacttgaacccaggaggcagaggttgcagtaagccaagatcatgccactgcactccagcctgggcaatagagcaagactccatctcaaaaaaaaaaaaaaagattaaagggaaaatgaacacagagaagagtagattacactgtaagcctttgaagagttttctgtctaaaaccagagaccgaagaaacaaacaaagattaactccgaaatagcacataggagctggcaggagccagaggtaggcagtcaggaaatgctgtcggagggagcaacaggtaatttgggctttgaggaccgggtagttctgtgactggagaagtggaggaagggcatttctagcagcgggaacagtatatgcataagcagacagaggcaaaagaatgtggctggggcttgagatatgtagccataaatgggaatgcaaaggtgaaggtaagttggactagattttcaagagcattgaatgccatgcccagaagtttgcacttgctcttctgagaattcacgtgctccagaagaattctgagcaagagaaagagtgacaaggtcattggctttagccactgtgtgcataaaacatggaagaaaaggcagggaatgaggagcaagttgggagacgggtgaggggggatggcacccaggaatggatggcgggatgttaaggaaggtgacccactggggatggggatggggatagagggcaggcagttgaccatgactctcaggtttctggtgtggacaactggatgggtcatgagtgccatgaaccacaagctattcatggtcccactcaataccctcctcttggggggcctgagtcatggttggccaagggtgtcatggcatctctggggtctgcattgctaagctcagttccaacagaccttggactgaacttctgtgcagtcctctctggcaaagatgggctcagagacccttggagcaatgcagcagagaccatggcagcagccacatcagcatctgaaaacagcggcacccggttattttccctccttcagactcagggaatatggtgggggaggggagatttggtataagggccactttaagtatcttccagaatcccattggaagggggagaaaatcccatttttttaagagcccactgataccacctttaaaaagaatacacagggggccaggcgcagtggctcacacctgtaatcccaacactttgggaggccaaggtgggtggatcacctgaggtcaggagttcaagaccagcctggccaacatggtgaagccccatctctactaaaaatacaaaagttagctgggcatggtggcacgcacctgtagtcccagctacttggagaggctgaggcaagagaatcacttgaacctgggaggtggaggttgcagtgagccaagatcataccattgcactccagcctgggcaacaagagtgaaactccatctcaaaaaaaaaaaagaatacataggggaccactaaactcctagaccaagggcttttttgaaaatagctgtgaccaggtgtagtggctcacacctgtaatcccagcactttgagagggtgaggagggcagattgcttgagctcaggagtttgaaaccagcctgggcaacatggtgaaacctcatctctacaaaaagacaaaacaattagccaggcgcagtggcgtgtgcctgtagtcccagctacttgggaggctgaggtgggaggatggctttagcccaggaggcggaggttgcagtgagccgagatcgtgccactgcactccagccttggtgacagagccagaccctgtctcaaaaaagaaaaaagaaaagctgtgcagaaatgggggtggggaatcagccaacccccttgtgctgggtctcagggacacccaatacagctgctcaggcccagccagatggcaaagggccctcaaccaaccctgggaccagaaccacaaaaagccacgtacttactggctcccgagcccaagcttaacaggtgaaatggaccactcttcaccaggaagggcagggctgtgccaagctcaccccagacttctaggcctgggagggtagggtcccatggagctgtgggctgccccctacccaacctgacctctgcttcctctcttcccttcttcccacctaaacattcctccacagtggcaatagcaaaggaaaagacatcaacacgattaaatccctccgagtcctccgggtgctacgacctcttaaaaccatcaagcggctgccaaagctcaaggtgagattgggagatggtggggtgcggtgggggggactgtcagggttatcatgtacagctgagcaggttgtacactgctcaaggacaacacattaaaggaggtgctgataacatcctagccatcgtgtatggatatttgtattattacaacttcccagcagatggcagtaaagtgagctgacctaaaataatctgtgtattatggcagtttttctttagatgaagtgtcttggggttaagatcctttttcctaattcgcatgaaggcatcatatggatttaaaagggtataaccgtgatctgggaagcaggaactagatttcttgttccataaaattttgacttttcatctacctattctaggctctagtatctcccattccaaaatagcatgaaccagcatttcccaaaagcctgtcattcaaaaacatatatatatattaagggaaataaaatccagtcattagagcacccactttcactctatgcttcacctgggggtccccagtattatctcttatgtaatatgtttctttaaatcaagtcacacccgtaatccctgcattttgaaagaccaaggcaggagtgttgcttgagcccaggagaatgagaccagcctgggcaacatagttagactctgtctctactaaaaattaaagacagaaaacagatactgttatggaaatctaaccaaatatggctgcctgcctaaggctttgtgcattgacaactgctctttcttggttaaagagggaaaatgtcaatggtaggtgttaacatggtagcaactaagtaaaaatttctccttcactcaaaaggattgagagagttggaaaggaagtaactttgttaccttgtttttctgtgttgggctcctgtatcacttaaaagcatctctggtatcccatctgggagttttagatccatagaatgccaggattgagtccaactcctccaacgcttatttctgaaagctggggggaccttaccctagtgacttgacttatgaccttgcctgtaaaatgggaatgatcatggcagtattttggtatgatgggccactggaggcagaaggttgggcaggtccccagcccctcatgctctctgtcaactccaccccacaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcggtgggtctccactttccagcacattcccattggaaccagcaggtgggcaggggggaagtggctagaggcattggccacttgggctcagagactggagaagtgatgagccttggaagtgactcagttgcaaccagcttggatcttgggtagaaagaaaaccggttttagaatttgagtcaccacccagagccacagaatgagtcataagcaaattgattgacctttcagccaccgcctttgtcatgtgagggatattaatacacatccacagttccttacttgaaatcgttacaggcagatgtgtttcaaagttgagaatattttgagattcccatgtgggacatgacaccctcagctgggtctaaggcagccctataatcaaacacaatatttctgccataaaatgtgtaactatttacatcaaatggggtaaataacaagtataaagagcttcatgtccaatcagatcaggtttcattaccaaataagttaggtaagaggccaggtgcagtggctcacacctgtaattccaacactttgggaggctgaggtgggaggatcacttgaggccaggagttggagaccaggttgggcaacataatgagagcccatcctacaaaataaattttaaaagttagcggggcatggtagcacacacctgtagtcccagctacccgggaggctgaggcgggaggattgtttaaacacaggagttcaaggctgcaatgcactatgatggtaccactgcactccagcctgcgtgacagagtgagaccctgcctctcaaaaatatatacatataggccgggcgcagtggctcatgcttataatctcagcactttaggaggccgaggcgggcggatcatgaggtcaggagatcgagaccatcctggctaacacggtgaaaccctgtctctactaaaaatacaaaaacctagctgggcatggtggcagacgcctgtagtcccagctacttgggaggctgagacaggagaatggcgtgaacccgggaggcggagcttgcagtgagcccagattgggccactgtactccagtctgggcaacagagccagactccatctcaaacaaacaaacaaacaaacaacaacaacaaaaatatatatatatatatatgtatatatatatatgtacacgcacacacacatatgtattatatgtgtgtgtgtatatatatgtatgtgtatatatagtgatattgttaccagtgtaaagtggcattttgcaacacatggtagcctgttgttatcttgatggctatttattgaaattaggaggatgccagatgtctggataggagtctggaactaacccttgtttcctgccttgaaaaggagtagcaacctcccttagcctgatgaacctctaaatgtcccctatgtctctctgcctcctcctaaactccctccaccccacccccagcaagcctgaggctctcaccctgaggactagaagttatcacgttggaagagggtgctggaccctgggtcagctctcccaccaggagtaaggttgtgccatcacccatggatttatctcaaagtagatgcacacgtcatcccctatgaagcacaggaacacatggtggcaggatggggagtcactgcttcccaagcagtctaggctggtggaccactcttcctttccctccccctgtctctgataaccaaagacaagtgcaagacagcccctctttcccatttactaacagtccccactctctgtggcagaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacagtaagtggcccgactggaaatctatccaggaggagccctggggagcaggaggataaagggcctgagagcttagcaataagaaaggtcttggaggccgggcatggtggctcacgcctgtaatcccaacactttaggaggccaaggcagatgtatcacttgaggccaggagtttgagatcagcctggccatcatggcaaaactccatttctactaaaaatcccaaaaaaaaaaaaaaaaaaaaaaaaaaaaaagctgccaggcatggtggctcacacctgtggtcccggctactcaggaggctgagacacgagaatcacttgaacccaggaggcagaggttgcagtgagccgagattgcaccactgcacttcatcctgagtgacagagcaagactatggcctccccgccttcaaaaaaaaaaaaaagtgaggctgaatcatggacttagtctttatttaaaattttgagccacttgtggtggctcatacctgttatcccagctactcaggaggctgaggtgggaggatcgcttgagcccaagagttcaaggctgcagtgagctgtgattatgccattgtactccagcctagacaacagaaggagacccctatccctgaaaaaaaaaaagaagaagaaattgatatttgttcatcatggactttttgcattaattttgattttttaaaatattggagcaaaagattatcttgattactgagattttcagtacccccttaatttgcacccaaaacaaatgcctccctccctcacctcgtccaagtaatggtctttctctcagaggtcttggaaatgccaggctggaagcttggtagattccagcatgtgccctcagcatcctcacctccctccctctctcagcaaatatgccaacctgaacatgccctactacccactctcagacacatccagtactcacacatgtgggaataatgctaacccacaaggcacctttgagcaaagtttttttaaacacctttctcaacagacttcatttccatctgtctgaaaatcatcgcaatagacttaaatgattttgttcaaacaaggcactgaaggaccacctgccaaaaaattgtcatcatgaatacacaaatctatcatgcctatcatgtgaaggtatcgcttagacacagagcctttgagcagtgtgcaacctgcactactgtacagagctgctgtgcacttacccactctcatatatatccccattgtacctcctgagcacccagcaccacctgtgctcaaatacccactctacatgcatacacccacctctactccctccattgccacaacctgtctttaaatcccaacttggccacttataagtgggtggtcttcagcacgtccctttaaattgctgaacctcaagttcctcatgtgcaaagtggagccagtaataacctccctgggagggttgctgagccggtggggatgaattgttgaatattgtttccagcacacagcaagcccttcatgcacagcagtagaaatgactgacattggccaggcgtggtggctcacacctgtaatctcaacagtttgggagaccgaggcaggtggatcacctgaggtcaggagttcaagaccagcctggccaacatggtgaaaccccgtctctactaaaaatacaaaaaaattagccaggcttggtggcgcatgtctgtaatcccagctacttgggaggctgaggcaggagaatcatttgaacccgggaggcggaggttgtagtgacccaagatcacgccgttgcactccagcctgggcaacgagagcgaaactccatctcaaaaaattaaaattaaaattaagaaataactgacattgttgtcagcctttcaaaaaacagcgactacttaaatttctttttcatttccctctgttcctgttctgccatctcacttccaccctctctccaccttcctcatcaccccttgggtccctgtctctctccttcctgccccttccctctccctgccccattccttgcagggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgaggtgccacttccaattccatctgtcctttaaaaactggggacacacacaaactttaaaacacacacaacacccaggaacccctttctaggggtacctgggggagggaacagaagcattgtcccaaccgaatccagtcttcagggcagcccttcatggagtttccagaggaaacacatcatatagtgtatgtatcagtcagtttagactaggttatgccgcagtaacaagcaaccccagatttcattgccaaatatccacaaagggacttattttttgctcacactgcatgtcaacatcagttgtggatcttgccatctttattctggttcccaggctggcagagcagcagagcagcctccctctgagatgctccagatgaaaaagagagtatgtcagactgaggttcagttcttcaggcttgtgctcaaaaattacacatgtcacttctgctcacatttcatcagccaaagcaagtcacacatccattctgacatcagtggagtgggcaaatacaatctcccctagcgaagggtggtgaatatttatgaatgaaaagccaagccaggtgtggtggctcacacctgtaatcccaacattttgggaagctgaggcaggaggatcacttgagctcaggagtttgagaccagcctggccaacatagcaagaccccatctctactacaaatcaaaaaaattagccaggcaggatggtgcacacctttagccccagtaacatgggaggctgaggtgggaggatgcttgagcttgggagttcgaggctgcagtgagctatcattatgccactgcactacagcctgggcaacagagcaagaccctctctcaaaaaaagaaaaggaaagaaaatccagtcccctgtctaccagagagtatagacatgactctttgcctctctggcatcatccaagctaaatagaggacctagaatatatcctctgctcccttgacccttaagacttaataaccactattcctccttctctctccctcaaagagaaggagaagacgcagcaaagtattcagtaagaaagaatgggctgggcgcagtggctcacgcctgtaatcttaacactttaggaggccaaggcaggaggattgcttgagcccggaagttcaagaccagcctgagcaacatagtgagaccccatctctatgattaaaaaaaaaaagttttaattagctgggtgtggtggtgcacgcctgtagtcccagctactcaggaggctgaagcgggaggatcacttgagtccaggaggtcaaggctgcagtgagctgtgattgcactgcactccagcctgggtgacaaagcaagcccgtgtcaaagaaaaaaaaaaaaaaaggaaggagggagggagggagggaaggaaggaaatgagagagagaaagaaaggagggagggaaggaaggagatagggaagaaggaatgaagaagaaagaaagggagcgaaggaaagaaggaagaagagagaaaggaaaggagaaaggggaaagggtggaaggaatgaagggaaggaaggaaaaaggaaagtgaaggagggagggaggaaggaaggaaaggagggagggaaggagggagggaaggagggagggagggaaggagggagggagagaaggagggagggagggaaggaaggagggaggaaggaaggaaggagggagggagcgagggagggaggaaggggaagaaggattaggcttcaatttgatttggcacactcggtagctgtgtcacctcaggcaagtggtttaacctttctaagcctctattttggtgatctgcaaagtgaggccattgatagtacccacttcccatgtttgtattagccatgcaataatggggaaatgtcagtgcaagttttggcagttggtgacatctcaagcaactgtagctgttgggataagaaagcaatggtgagaaggaagagagagcccaggaatcctggctgggggcaagagaggcagagactcaagcagaagcacttgagaaccgcgacgagttagacagagggtgcccggtgtacagccaccttcctcctgcctctgccgctctcaccactggcctctctcccgcagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaaggtaagtgccccacaccagcccccagcactacttaacccccacctcgttcctgcctctaccctgataaaatgaaaccatctgcagtttcccagacagaccacactctggatcacctctgagattttgttcctgctgttccctctacctgacacactgttcccaccactcccccggccagcttcttcttcccagctgtacctgcagacctcttcctccagaaagccttccctgaccacccaagactgcttgaggtgcccatcttagcaggcatcctatctttatgtcgcctgccacaaaaatctgcgtcaggttgcatgacagtgtcccccacccatttatgatgacctcagccctgaattcctagaggccaacaaggatctggctcagacggaacaagaagctctctataaatgtttgattaatgaaatgagggggctgggcgcggtggctcatgcctgtaatcccagaactttgggaggccgaggcgggcggatcacctgaggtcacgagttcgagaccagcctgaccaacacggagaaaccgcatctctactaaaaatacaaaattagccaggcgtggtggtgcgcatctgtaatcccagctactcgggaggctgaggcaggagaattgcttgaacccgggaggcggaggttgccatgagccgagatagcgcaattgcactctagcctgggcaacaagagcaagactccatctcaaaaaaaaaaagaaaagaaaaagaaagaaatgagggagaaggggtaggtgaggaccctaaaatccccagggctaaggagcggcttccaaaaaaaaactctgaaaacctttcaccctgtgctttggactccaaagcgtggattcaagcccagctcttccatttaattcatttacctttgtacaagcaaccagtgactttctggggactcagtttccctgtcaataaaatgggaatgataataagagcacatttgccccctccagaggaggtgagaggattgaatgagaaagttcatgcaaggaccttagctccttctcggcacttcaaaaacgatcaatagtggccgggcaaggtggctcacacctgtaatcccagcactttgggaggtcgaggcaggcggatcacttgaggccaggtgttcgggaccaactggccaacatggtgaaatcccgtctctactaaaaatacaaaaattagctgggcgtggtggcgcatgcctataataccagctgcgtgagaggctgaggcatgagaatcgcttgaacccagggggcggaagttgcagtgagctgagatcacaccactgcactccagcctgggtaacagagtgagactccgtctcaaaaaaaataaggaagccggggacggtggctcacgcctgtaatcccagcactttgggaggccgaggagggcgatcacaaggttaggagatcaagaccatcctggctaacacggtgaaacgctgtctctactaaaaatacaaaaagttagctgggcatggtggtgggcacctgtagtcccagctacttgggaggctgaggcaggggaatggcatgaacccaggaggtggagcttgcagtgagccgagatcgcgccactgcactccagcccgggtgacagagtgagactcctcaaaaaaaaaaaaaaaaaaaaagtataattcagccaagcacaatggcgtatgcctatagtcccgactatcaggaggctaaggtaggattgtgagttcaagcccagcctgggcaaaataggaagaccccgtctaccaaaaaaaaaaaaaaaaggttgggggaggtttttgtttttttggatgtgaaaagaagagcctagtccggcggagagcggggctttcctgaactgtgcctcctaccagtgaggttgctcagaccttgcctggggctggagtgttgcctggagaacagccatgaagctgcctccccacttcccacttcccacccctgctcgctgacccctgctactcctgcttctttcccctagttctatggggcttctgttgcttatgaaaatgccctgcgggtgttcaacatcgtcttcacctccctcttctctctggaatgtgtgctgaaagtcatggcttttgggattctggtaagtaccaccttggggctacagctatgggcttgggagaagcccaagggggaacaatgggtcctggatgatggtctcccaacgtggccccaagaaccccaacctcaagggtggcttcagtatcctgccagtggccacagatcctacttaggcattcttgtgtttgccaaggagtcccagggagacccaacctgtgagtgttaccatatggctgcttatgtatccagttcctcaaaatgatgggagtcatcatggctgggagtctttagcatccattttagagataagaaaactgaaatcaggctgggcgaggtgtctcatggctgtaattccagcactttgggaggccaaggtgggcggatcacctgaggtcgggagttcgagaccagcctgaccaacatggagaaactctgtctctactaaaaatacaaaattagccgggtgtggtggcgcatgcctgtaatcccagctactcgggaggctgaggcaggagaatcgcttgaacctgggaggcagaggttgtggtgagccgagatcacatcactgcactccagcctgggcaacaagagtgaaactctgtctcaaaaaaaagaaagaaagaaagaaaactgaaatcaggctgagcacagtggctcatgcctgtaatcctagcacttcaggaggccaaggcaggaggatcgcttgaagctaggagttctcaaccagcctgggcagcaaagcaagcccctgtccctacaaaaaaaaaaaaaatttttttttaattagccaggcatggtaactcgtgcctgtagtgccagttactcaggaggctgaggtgggaagatattttgagcccaggaggtggaggttgcagtgagctatgatcatgccactgcaccccagcctgggcaacagcaagactccatctttaaaaaacaaacacagaggtcaggcacagtgactcacacctgtaatcccagcactttgggaggcagaggcaggcaaatcacttgagcctaggagttcgagaccaccctggccaacatggcaaaaccccatctctactaaaactacaaaaaattagcctggcgtgcttgtgggtgcccatgatcccagctactcaggaggctgaggcaggagaatcgcttgaacccacaaagtggaggttacagtgagctgagatcacaccactgcactccagcctgagcaacagagcaagtctcaaaaaaataataataataaaaataaatatgtctttatttttcaccagccactaactaaattttaacatttccttccatcttaaagggagataacaaacccttagtattagtattatcaacccttaatattatcaacatgacctgtgtcacttataaacatcagatattttcatactgcattataagagctgcagataccttaacatttaatttgcattcatcattgctttaaaatgttgcttgtgattaaacctacagctagaatttgttactcagtgtttttttgttgttgttctgttttgttttgtttgagacagtctcgctgttgcccaggctggagtgcagtggcgcaatctcggctcactgaaagctccaccccctgggttcacgccattctcctgcctcagcctcccgagtagctgggactacaggtgcctgccaccacacctggctaattgtttgtatttttagtagagatggggtttcaccatgttggccaggatggtcttgatttcctgacctcatgatccgcccgcctcggcctcccaaagtgctgggattacaggcgggagccaccgcacccggcctactcagtgtgttaatggagaagtatattcattgttagatcgccatttttaaaactttttttttttttttgagacacagtcttgctctgttgcccaagctggagtaccgtggcacaatcttggctcactgaaacctccacctcctgggttcaagcgattctcccatctcagccttctgagtagctgggactacagatgcacaccagcatgccaggctaatttttatatttttagtagagacggggtttcaccatgttggccaggctggtctcgaactcctggcatcaagcaatctgcctgcttcagcctcccaaaatgctgggattacaggcatgagacactgtgcctagccttaaaaaatattttgatagctattttattacaaaaggtaaccttgaagcccttgctattttgttatgcatttacaagcctttatgcataaaataaaatagccagcactattctcacatggccaaggttcatagcacacacacaaaagtatagttggctgagtgcggtggctcacacctgtaatcccaacactttgggagacagaggtgggtggatcatgaggtcaagagatccagaccacccttgccaacatggtgaaaccccatctctactaaaaagtacaaaaattagctgggtgtggtggcgcatgcctgtagtctcagctactcgggaggctgaggcaggagaatcatttgaacgtgggaggcggaggttgcagtgagccgagatcttgccactgcactccagcctgggtgacagagtgagactccatctcaataaataaataaattaaattaaattaaattaaaattattttttaaaaaattgggggctgagtgtgatggctcacacctgtaatcccggcagtttgggagcttgaggagggcagatcccttgaggtcaggagttcaagaccagcctggacaacatggtgaaaccccgtctctactaaaaatacaaaaattagccaggcatggtggcgtgtgcctgtaatcccagctactcgtgaggctgaggcccaagcatcgcttgaacctgtgaggcggaggttgcagtgagccaagatggcaccagtgcactccagcctgggtgacagagtgagactttgtctcaaaaaaaaaaaaaaattaaggtgaagaaggcttatactagtgggctgggacttgaagtgaagtgaattcttgaaggtccccagtgagtggccaaggtgggacttgaaccaggacatctgttctcttgaccaccagcttagtccatccctttgaagagagtgacctacagtctgggtctcagccagggtctcaggaaaccaggttcccaccttggctcacggaggtggttaggggcatcagctttagcaccagagttcagatcttgcctcgtcctatataagctttgtcacctccccatcattaaaaggagccatcctccccctccacctcagcagagccctggtaaacagcaaatggactaacgtgcatctagagggttgaggatgaagcctggcctggcatgggcactcaataaatgctaggggccaggcacggtggctgacacctgtaatcgcagcactttgggaggctgaggcaggtggatcgcttgagcccaggagtctgagaccaacctggacaacatagtgagattctgtctctacaaaaagtacaaaattagcctggtgtggtggcgtgcacctgcagtcccatctacttaggaggctgaggtgagaggatggattcagcccaggatgtcagggctgcagtgagtcgtgattgagccgctgcaccccaccctgggtgacagagcaagaccctgtatcaaaataaataaataaatgctaggaaagggatcctactaatggacctttttcctccaaaacagtggctttcatttggtggagatgctacttattagaagcacttgaggccaggtgtggtggctcatgcctgtagtcccagcactttgggacttctgccaaggcagaagaattgcttgaacccaggcgtttcagaccagcctgggcaacatagcaagacctcatctctagaaaacattgaaaaattagccagcatagtggcacatgactgttgtcctaactacttaggcgaaggcaggaggattacttgagctcaggagttcaaggctgcagtgagctgcgatcacatcactgccctccagcctgagcaacaacacaagacccggactctaaaaatcaaaaaagaagcacttagggaaatttcttaaaattaaatgataccctgagcaaacccctagatgttctgattcatttggtttggtgaggtgggagggaatcactgaatctgtaatttattattatttttttttttttgagatggattctcactctgttgcccaggctggagtgcagtggtgcaatcttggctcactgcaacctctgcttcccgggttcaagcaattgtcctgcctcagcctcccgactagttgggattacaggcgcccaccatcacgcccggctaatttttgtatttttagcagagacggggattcaccacgtcagccaggttggtctccaactcctgacctcaggtgatccgcctgcctcggcctcccaaagtgctgggattataggcatgagccaccgtacctagcctgcagttattttattctgagttgatcttctgctggtgaagtgagtcttccactggggcctggagctgcatctccctcaccctgccaatcctgcaagagccagcactgagcttcccctctgctttctcttttttttttttttttttttttttgagatgggatcttactctgttgcccagcctgttcttgaactcgtggcctcaagcagttctccctccttggcctcccaaagtgctggaattataggcatgagccaccacgcctggtctcccctttcagttttaaatgaagccacaagttccctgtataacatttgggagatagaggggagctctctagcctaggggttgaggtctgtgaccaaacgcctataaagttgtctttgtttggactcccccagaagcagagcctgagacaaggattgagtgcaaggaatttatctgggatgcagggcagtaagggagagaggaagtgacacagggacagaaaggcaaccaggaaagagtgtattattaagccagttcctgctgtgaacaaatggggctcagtttcagtggatacctccaggaggcaacagagagcacataccacagagtcatcccacctcacagggagggaattggagtatttatcctccagtgcccatcagacataatcacaggccactcccaggggagctattaattccctaacacttgtgcagccacagagagaccctgggcaaagtagtgtacctcaggtgtgtagttgagctatgggcagggccccagcaacacctgccaaaatgccaaaagtgccagtgggacctgaattcctttttatttatttatttatttatttatttatttttatttatttatttttgacggagtctcgctctgtggcccaggctggagtgcagtggtgcaatctctgctcactgcaagctctgcctcccaggttcacgccattctcctgcctcagcctccggagtagctgggactacaggcgcgcaccaccacgcctgcctgatttttgtgtgcgtgtatttttagtagagatggggattcaccatgttatccaggatggtcttgatctcctgacctcgtgatccgcccacatcggcctcccaaagtgctgggattgcaggcgtgagccaccgcgcccggccccctgaattccttttttaggcagttgtgaaacaacaacatcccatctgttgggcacctactgtatattccatgctcagcgacgcacattcattgtctgattgctgtgttaccactgccttccagagaagggcgcagaggccccaggcacttcgcctaggagggaagcacagctctaaggtcaggctccttctctgtaaggtagaggggctacttcagggtcacactgaccgccccaacccctgacctggcctctgcttctgcgaagatgctgagaaggccctgtgttttgtgttttgggtcccactgaccccagaggggagggccatctctttgacccagactcttggatccaaactggggtgccacccatcaccatgtcagtacccggttgaggggagtcagagatagcaggagaccttgtgggacttgaggctgtgactgttctccaaacaatgtggagtatttccatattttaacaaaagagaggccaggcgtggtggctcacgcctgtaatcccagcactttgggaggccgaggcggatggatcacaacgtcaggagatcaagatcatcctggctaacatggtgaaaccccgtctctactaaaaaatacaaaaaattagccaggcgtggtggtgggcgcctgtagtcccagctactcaggagactgaagcaggagaatggtgtgaacccgggaggcagagcttgtagtgagccgagaacgtgccactgcactccagcctgggcgacagagtgagactctgtctcaaaaaaaaaaaacaaacagagaggttatgcttgtgtttccccttgagccagcacccagcccaggaatgcagcagtcaggatagatcaagtgaagctgcagtaacaaacagcccccacatctcagtgacttaaattgatgggaagggttttttacattcagcagggaagctgtttgcctcatagttacccagggacccaggctcacagagtagctgccattcaaaatgttactggtcgccaagcccagggttgagaggctagagagtccaacactgaccagaaagtgaccacactgcttccacacacagcacatcactgcacctagacacacatggccccatctaaacacaaggggaccaggaagtgcgtgtgcctgaaaggccccaaagccccgtccagtgcctgttctgcaccctgttactgtccgcctccagatcaggaaatggaggcccagagaggttaagccacttgcccatagccacacagctgtggtagcagagctgggatttgaacccagagtctcctttctttgcgagtatgctgccaacctagtggggacctgaacacagactgtgggctctctgaggcctgggttcaaatcctggctttacatctctgtgctgctagcctcaggcagatgagtggcttggttacctcctagaaaatgggtatacctgggagtggtggctcacgcctataatcccaacactttggaaggccaaagtgagcagatcacttgaggtcagaagttcgagaccagcctgaccaacatggtgaaaccccgtctctactaaaaatacaaaaattagctgggtgtggtggcatgcacctgtggtcctacctacttgggaggctgaggcaggagaatcgcttgaacccaggaggcagaggttacagtgagccgagatcgtgccactgcactccagcctggatgactgagcgagactccatctcaaaaaaaaaaaaaaaaaagagaaagaaagaaaaagaaaatgggtgataacccttccctccaggatcttcatgaggagctcagtgatgtcatttataaagcccctggggtctcgggagccctcaaaaatgctggagagacaggccacagctctgaagagcagccccagccctgtggagctgaagcagggtctggaggccccctctggggccaggccaatcatgggaaggcccccaggagttcccagggagggagactcagcacagatgatgtcgaacagcctttaccgcagcccttcgaacaaccataactgtcccgggcactccgctgatgggcaactgtgcctctaacatgcacccggccagcctagggggccgggaaccaagccctctgttggcatctctgtcttgtgggtccccattctagaattatttccgcgatgcctggaacatcttcgactttgtgactgttctgggcagcatcaccgatatcctcgtgactgagtttggggtaagtctccctccagcttctctctgggtgactctgggctggacgaggcaggcggcagggggcgggggagcggtcccagaggcagtgtgtcccggaagccatagctgcttgagccagcacttggccatgaccagagagggagaactggggccccggggacaagggcagcccctcaggagggcattgtggggagatgggggtaaccaaagcttggctgtagggccagcactgaggggtgggctttcctgcatcctggcctaggaattaataatgcagatgagtacactgagggaactgagacactcaaaagctctgaaagctgagccggctcccaaacaccaccctatgtcaggagcccagaaagaatgggtttcaagtcaattctgtttgaaccaaccctctcctagttagtgggcaggagagagccacagccctcaggccagtgtggggacaccactcccagggccatagaggggtccccagggtgtcttccctcctctagccccgggcctgggagactctcaacatgggagtctctggacctctctgtggtggccccacaggccacattgcccttctccttttctggaagactcagggccccagaggtcctgtcctagaccctctccttggccatctgccaatgagcccaggcttggggtccctcaggagattggggggagggtagaagatccttgcagggggaagcaatggtcaaaaaagggtgtcaaagccaagggtcaagggtgataccaatgtcatcttactaacaataaaaataacaatagctcacgagaatcgcagccttgctgtgtgccagggaactgtgccaagtggtttacgtggattggctcagggtagaggtcttggtctcagctcgtaagagaattccctcggagggttcaactgaaggcacccaaatgcagacctcactggtggaggggaagggaagggtacccacaagggtggcaaggtgtccagcgaccacccaccgtggggagctgtcacctgcccaggtgctgaagtggggagggaacctgagccggaggccaggagaagccaccaagtgggagctgtcctgtcaatgtggagagacagagaccagggcccaagcaggcagagagcaataggggagaaacaccccaacctttctctcccctcatcccttatctcctgccagagcctcccatggcccaaagtaaaccggaagcaagctgaatatgatgctcagagcaggcagggaagtcaggagaatagatctgggtgtggtcgggcctgaggaagagggtgttgcctcatttcacagatgggaaaactgacctcagctgggcacggtggctcatgcctgtaatcccagcactttgggaggccgaagccggcggatcacctgaggccaggagttcaagaccagcctggccaacatggtgaaaccccatctctactgacaatacaaaaaaattagccaggtgtggtggtgcatgcctgtaatcccagctactcgggaggctgaggcaggaaaattgcttgaacccggaaggcggaggttgcagtgagcgacggtcataccattgcactccagcctgggtgacaagagcgaaaactccatctcaaaaaaaaaaagaaagaaagaaaactgatcttcaatgcctggggaagtgagagacactcccaaggtcacaaagccaggcctgggtgactcctgagagtacactgacagctcctggggtgtcccagtcagatccccctacagaaaaggatctgtttgcctgctcttccgtcctagaaggccaggaggggctggggaactacacaaaagagggggccattctttgatatgtcctacggcacccgcacccaagtgatacacacttatttgccttcagctccagtgagccagaattttccccttcccctcaccctatccctgaaaccttcctctagagggttcttgcccacatgggggctctctccactggggtgcccccacctggtcattctcccctgtcctgagtttctagagagggctggagctccagctggcaatcaaaatatcttgccatccggctacatacaagacagccttgaaccaatgtccctttgggtcaagaggttagaaggatggtccagctccccagaagggcaggtggggtggaggaagttagctgaaaccttcaatcaccagtaagagagctgtagggacagactccaacagcctgttctcctggctggcaggaagatggggcatggggtgttcatgggacatcaggacccttgcagtagccaaacagcccccagccctccctaccagctgtttgatcttggacaacttgcgctatctcttctcatgtagagtggggctaaccattgcaaccaacctcagacacttgcaagactcacagtgatgcatgcactcaaaagacattcattgagcacctactgtgtgcctggtgtgattataagtgctggagacagaacgagaaggaggggtgccaaacaaaacagaccaagaatacagagtgtctgctcccatagagctgacattctaaggagagagacgggaactttttacaagtaaaagcatcaacaggccgggcatggtggctcacgcctgtaatctcagcactttgggagaccaaggcaggtggatcacttgaggtcaggagttcgagaccagcctggccaacatggtgaaactctgtccctactaaaaatacaaaaattagccgggcacggtggcaggtgcctgtaatcccagctactcaggaggctgaggcaagagaatcacttgattctcaggaggcgagaggttgtagtaagccaagattgtgccactgccctccagcctgggcgacagagtgaaactctgtctcaaaaagaaaaggaagaaaaagaaagaaagaaacgtgaagtgcttggcacagaacctgccaggaaaccaggagtttgaaaatggtggttgttaactattactgctgttgttattgttattgtgaatgggtgtgtagttttgttagccagccctgagttacagtcaatttgagggaaagatagggggtgggtgtttgggtccttctgggacaattaactcccaacctggagtagggagaggcatgtcctggcaggcaaggaggtctcagttgcccctttctgcctcccaggtaagcccactagttctgaggccagggcttggccaggctgagacaggaaatgccagatgcttgggcgggcaggtccctggggtttagggggcagagggcatgcggcagtactaaccagtgctgtctcagctgctgcccccaagtggctggggtgatgtgggtttgccctgtgtgcaatggataatgactgtgtttcttgtcttgtctcttttcatgcctgctcttaaaactgtatattggcgcaacgccgtctgaaaaactcatccaatcaaaatgcactatgaaattcatttgttcatccatgacatggtctgtgtgttcatacaccaatgacttatctcccaacccaccgccaccaccacccccactccccgcccgggaaccgaaacccattggttttttggcactggttacaaatcaacctaaaaaatgctgaacacgcctccccaactgcccccgcccgcccgctccccctcatcttcaacatctgcatctagaatccggttggtcttacttctttctgaagtctaaatgccttacattaactgtgaacgcatctcctcgcgtcggcattgcatgccacaccctgcctctccaacgtgggatgcctgacgctctcctcaaccctccgctctcctctgtctgtctgtcctcccgcccccagcccctgtgcctcccacttcctgtagactctgtctctctgtttttatcgggttctgaatgggggttttctgtttggggtggtttgcgtcttttgcagagaaagggatgggttttcccagcgcagcacctctctcttgccccatcccgcacacacatcccctacactcagagacaatagaggcaaatccactcccagccacctctcaccactcctgtcccccattcagctccatggaccccaggccccaggaaagctgccaactgtctcctcgcccctccagctctctccatcctgctgtccccaatcctccatctcaagcccacaagatctttggccttgaccagcagagacttgactctccaagtctgataaaggagacctgaaggccaggcagtgtgccggcaaagactctcaggcagaggaactcagaagtgccagacttggatctggtagcttcatgtggggctggcccactgaggccctctcctggagccttgaactgtacgtgcacacgcagtcacacagtcactgcacacagacactgcacacacagtcactgtgcacacactcagtcactgcgcacacactgtgcacacagtcactgcacacagacgctgcacgcagtcactgcagtcactgcacacagtcactatgcacacacagtcactgcacacagacactgcacacacagtcactatccacacacacagtcactgcgcagacactgcacacacactgcacacacacaatcactgcgcacacacagtcactgcacgcagaaactggacacacagtcactatgcacacactgcacacaccactatgcacacacactgtgcacagtcactatgtacacacactggcactgcatgtagtcactatggacacacactgcacagtcactgtgcacacatacactgcacacactgtcactatgcaaacacagtcactgcacacagtcactatgcacacacactgcacacacagtcactgcacacagagccactatgcatgcacacacagtctgcattcacacattgaacacacagtcgctatacacacacagtcactgcacacacagtctatgcacccacacactgaacacacagtcactgcatgtacagacactgcacatagtcatgacctcttctctttttctcactcattctccaattctctctctctctcgctcttttttttttttttttttagacagagtctcgctctgtcacccaggctggcgtgcagtggcacaatgtcagctaactgcaacctctgcctccccgtttcaagcaattatgatgcctcagcctcctgagtacctgggattacaagcatgtaccaccacgccaggccacttcttgtatttttagtagagacagggtttcaccatgttggccaggctggtctcgaactcctgacctcaagtgatgcacccgcctcagcctcccaaagtgttgggattacaggtgtgagccactacacctggcctctaatcctcattcactgttcctgtctctgtgtctctcacatacagtcatgcatgcatgcacgcatgcacacacacacacactggccctctctgctacatctacccaccctgtacccccactccagtacatactgcacacatctctctccctcccccacttctcagccccttgcacaccccttgttctgttaaatctcaactgcctctgcccctctcctacccaccaatgaggcccttagagggacgccccaatggcatctttgccctggaatcatcccttccctgctggcaatacacatgcattcacccaccaaacatttaatgagcccctatttggtgccacagatggaattatgggcagaagcagacaccattactgtcccctcttaccacatacagtcaggtgggggaggcaggcatcggtcaaataaccccttgactccacttaaaattatacctgcactgcgagctgaaggatgagcagcattaacaaggcagagagagatgcacagagcattccaggcccaggacagcacatgcaaaggccctgtggtgggacggaacctgtgaggggtcaggatctgcaagcgagggaatgtggctgatgcaaagacagccgagaaaggctggcctggagacagccgaagaaggcagaaggggacaggacccggggctggggagggcggggctatattgtggaatatgggctttctcctaagcaccaggaagggcctgggaggataggaagcaggggaggcgcgactggtcatgtgactagacaagctcgctctggttgcagggcagggaacagcttgacaggaggctgggctggaggtgggcaccaggaatcgcagcaagagatgacagtggaggagagagaacagtgggagggttgtcctctgcaggacccagggaaagatcaggtctgaactgagatgaggtgcctgggagcagtcgggtctggcttaaaactgggagataggctgagcacggtgactcaagcctctaatcccagcactttgggaggctgaggcaggaagatcacctgaggtcaggagttcgagaccagcctgaccaacatggtgaaaccccatctctcctaaaaaatacaaaaattagccaggcgtggtggcaggtgcctgtaatcccagatcctcaggaggccgagacaggagaatcacttaaacctgggaggtggaggttgcagtgagccgaggtcgtgccattgcactccagcctgggcaacagagtgagactctcttaaaaaaaaaatactgggtgatagaggtgagcgagtgcaaggaaaggaccaggttgggggaagagaataggtgtgggcatagcaagtttgaggtgcctttaggacatcccgaaataagtcagataggcaggtgttgtgggggctgcagcttggagctgaggtctacaagtagtaggacttttctggagcccttaggtgggtggtctccatatccttctgagcacttgaggaacatctgagcacagcactggaaaagaaaagaccacaaggacgctgtcctcatgtcttccaggggctgtgtcccacccccatcacattctagccaggaagttcaggggaggtgttgaagagaggaagctgcacctcccaagccatggattgaaatgtggaaggcaggaagagggaacttgtcagaagttctgggggcagtggaaagaattggtactgatgcaggaagagatggagggtggatgagggcagactagtacccttcccccactgccccaaacccttcccgtctccacccctacctgcctcatgtgtctcctcccccacttggctccaagaagggaagcatgttttctgcacgcatctccctgccagatccctggcttttttgcatggttgcaagcttcccctgctctcctccaaacccccctcctgaggctgcttccagggtccgcctgccttcgcatgcctggccgagtccacatgttatgatccgccccatgaaagggatggcttgtactctggggttgaacgggagggggctggggatacctgagccatcggccccatccccaggtggagctgggtggccaggcagggatgggggtcagggcagcagggcacagagagtgactctgttagccaagctgggtttggggcttgttcgaggcactggagacattctcacagcacttgagcccagtgtggtcagggtaggatcccccagcccccttccccatcctagaggcctaaggacgcactgatgtgtcccagagagcatcctagacattgccatcaaacccagaggcctcagaaattccttgaactccagtccttgcctctcagctcccaggccaaagccagcacaagacacagatctggcagccagaaagccctctggaagccaccaagtaggatgcccatgtcacccaaactaggacacttttgaaacaggagggaggctgtgactgtatggtcaccctgtgccatttggggggtgaaggttagaccaagttaaatcttgctacgtggcctgtagcaaatcctacaaatcccatagaacaagtctgattaagccccttcccttagtgtggagagaccctctactcctcctgccttcaccctgctgggtactggccagcgaaggagggtttccatgtctgcctgaggctggggtctcaaactcaaatgcctctgggggccaggcagacaccagtcaaccaggaaagcaagtgccatttctaaaacgtgaggaccctggaaaactggagatcatgtggcctgcttccagggagcaatcgcagcaggcctggggttgccagaaagccagattggtgggcaaaatctcttgatttttaaacaatggcaataatttttaattaaaaacaaggacaaatgaaaaaacactgctcgggcccaacaaaacagttttattagctagatttggcccactcgtgacttcgagagtcccaccccccccaccaaggtcccttgaagccccacaatggccacttaactctagctggtctcctccctgactctccaactctctggccccctggttcttctagcttgggtgggaggaggcagaggcagtgactagacagggggtttttgagcagaggcagtggccacccagggaggtcctgggggcagggatggccccacctcccggcccccagcacccgccccttggtgggcccgggctgatttctgagctcacccacccatgggagctgagtgcttcctgcttcctgcaggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaagggggtaagaaaagatgctcttccgcttctcccaattggctcgagccgctgctcctcttggccgtggggtgaggtcagggcgggcaggagcgggtgggcagctcggcagggcagggcagggcagggtgcccggtgagtcccgtgacagatgcatttctggcccggagcgtaacatgccctcggaacccgcacatgtccaccaggcctgactgtgctggcgacctccacccccacccccgccctggtgtttgtgcatcgtacacgtatgatagattccgcaacttgaccggcttgtgtcctttcgtctcagtgcatttggttgttgggagaaacaaaaaccatctcgatttttttcctgattggatgattcggatatattttctttttcttgttcttttgttatttcttccccatccccgttcctttttcctcctttctttttcttttcttttccccattgtgggtggggctggcagggagggcttatgcttttgagttgatgccttttcctccctcccaccctctctctcccaacattattcctttttcgagtttttcctctgcatcattgcattaatagtgctttctctctccctccttatttggggtctggcttgcttttttcctgttggttggcttcatgtaggggcctctgtgagtggtgacagctctgagccttttggggtgggtggatggtcacccctcttcctccatctccccagaataacttcatcaacctgagctttctccgcctcttccgagctgcccggctcatcaaacttctccgtcagggttacaccatccgcattcttctctggacctttgtgcagtccttcaaggtgagtcctcgtccctgctgctggcccagggctgagaagacaggtgaccctcatgctctggctgaatgtagaagtcagattggaagtgcctctgtgatgtagtcgtgcagagaatctgttatctccaaggctgttgtcaaacttcctgtccctggtgtgtcttcagagctgtaagggcctcatcctagagcccccagagatgcccaccagccctggaaggactctggcacgtggcatatggccacccaacccagtggggcagagcactgggacaagggaggaagacagtgcggctgagggacccccagcactcttcttcattgccttttttcccaccaggccctgccttatgtctgtctgctgatcgccatgctcttcttcatctatgccatcattgggatgcaggtgagtgtcgtgtccctaaggttcccagagcctcccaaggagggcagccacccttagaaaggggtgggtcagaggagcctggttcacagaagcagccatggaggttgagctgggtttcccagaagccactggaggaatggcagcccctggtcgtcaccctccaattccacaggtgtttggtaacattggcatcgacgtggaggacgaggacagtgatgaagatgagttccaaatcactgagcacaataacttccggaccttcttccaggccctcatgcttctcttccggtgagaaggggacctgctctgataattctgtttccgtggggtggggtgcctgccttcatccttctgttcccatagaggatgtaccctcctcttccaatgcaagacgtgccctcctccttctcttctggcaggggcgcgccctcacccttcttttccggtagggggcgtgcccttctcttccggtaggggacgtgccggccttctcttccgatagggggcgtgccctcctcctccttttctggtgtgggggtggccagatgtgctcttatccttcttttcccgtgaggctggaaatgggtgtcgtggggggcccaggaatcctagcagggcagaagcagagggccctgggacatagtcatcaaggtcattttccaggcattatctctgaatcttcctgaccaccctgtgaggaagggattcttggcagccctatccgacaaataagaaaacaggcttacagaccgtgaggcttgattctttggttcatcatcttggctgcacacaaaagttccttcactcgttcagtgtaggttttttgggggggctttttttttttttttttttttttttggagatggagtctcgctctgttccccaggctggagtacagtggcgcgatctcggctcactgcaagctccgcctcccgggttcacgccattctcctgcctcagcctcccgagtagctgggactacaggcgcccgccaccacgcccagataatttttttgtatttttagtagagtcggggtttcaccatgttagccaggatggtctcgatctcctgacctcgtgatccgcccgcctcggcctcccaaagtgctgggattacaggcgtgagccaccgtgcccagcccttttttttttttttttttagatggagtctctctctgttgcccaggctggagtgcagtggcgccatctcggctcactgcaagctcctcttgtggaggtgtattgagcacctacagcatgccaggcagggctgaaaaacgaggatgcaccaggaaatagagaaaagagacattttaagcactttggaagctaacatccccatggggaagacgaataatcaggaaacaaattatagaggatgctggaaaaagataaaattcaagaataaaggggaatagggccaggtgcagtgactcgtgcctgtaatcctagcattttgggaggccgaggtgggaggatcgctttagcccaggagtttgagaccagcctgggcaacatagtgagaccccgtctctacaaaaaaattgtttttaattaactgggcatagtgccacacacctgtagtcccagctacttgggaggctgaggcaggaggattgctcgagcccaggagttccaggctacagtaagctatgattgtgccactgcactccagcctcggcaacagagcgagactctgtctctaaaaagaaaaatatatttttttaatttttaaaaaaagttacagaggtagatagtggtgatagttgcataataatgtgagcttacttaatgctactgaattgtacacttcaaaatggttaaattgataaacttcatgctgtgtgtattttgccacagtaaaaaataataatgtttttaatctaacaacaaaaaaagaatagagggccggcaggttatgcctctctgaaagtgtgacatttgagagaaattggcaagggagggagtcagtgggtatatggggaagggcaggccaagccgaggggactgcctgtgtaaaggccctgaggcaggagtatggctggcatgtttgaggactgtgaggagcccagcatacctagaacagagtgatctagggagaatatagtatgagatgactgtcaccttcatggaggggagcttttttttttttttaatctgagacagagtttcggtcttgttgcccaggctggagtgcagtggtgcgatctcggctcggcgcaacttctgcctcccaggttcaagcagttctcctgcctcagcctcccgagtagctgagattataggtgcccgtcaccacgcccagctaatttttgtatttttagtagagacggggttttgccatgttggtcaggccgttctcaaactcctgacctcaggtgatccacccgcctcagccacccaaagtgctgggattacaggcatgagccactgcacccggcctgaagggagcttttttttttttttgcttttttttgagacagaatctccctctttgtcacccaggctggagtgcagtggcgcgatctcagctcactgcaacctccgcctcctgggttcaagcgattttcctgcctcagcctcccaagtagctgagactacaggtgagcgccaccacaccgagcaaatttttggtatttttagtagagatagggtttcaccatgttagccaggatggtctcaatctcctgacctcgtgatccacccacctcagcctcccaaagtgctgggattacaggtgtgagccaccgcgcccagccaagaggggagcttttaaagcataacagtgaccagcctgagcaatgcagtgaaaccccatctctacaaaaaaaaatagtttaaaaattagccaggagtggtggcgtgtgcctgtagtccccagctactcaggaggccgaggcgggaggatcacctgagcctgggaagttgaggctgcagtgagcagtgattgtgccactacactccaacctgggtaacagagcaagaccctgtcaaaaaaaaaaaagagagagagagagaaaagaaaggaaaagaaagagagagagaaggaaaagaaaagaaaaaaacatatcagtgtcctcaaatcccaccctagaccaactgaatccaagtctgctggggtggggcacgggcattggtattttttcaaagctctctgtggacttcagtgcacagccaagaatgtgaattcccttctctcagctcccagtaaaaggaggtggtccacctggggcttgcctggccagctccagagcccaagtgctcaacgtgtgtgctccacctcctggggaggcgttggtacccagtcagggctgggtgtccgagtctctgatttctccctgtcctcaggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctggtgagtctgtggacactgtgagggccgtctgggctccctaagcctggcttcctttcaggggagtgggtttctgtggaatgtggctgtgtcgaaggcttgttccctccaaggcttctctgaaccagcctgggatcaggtgaccctgagcgtctcaaactcagcactgttgacatttgggggtggctgattctttggggtggggccatcatgtgcactgcagtgtatggcagcatccctgtcctccccccaccagatgctggcagcacacgccacccgttcctcctgttgtgacaaccaaaaatgtctccggacattgccaggtgcccccagggggtgggggtggggttgggagtgggggccagaattcccccatttgagactcaatgaaatatttcagctgggcgtagtggccgatgcctgtaatcccaacacttcgggaggctgaggtgggagggtcacttgagcccaggaatacaagaccagcctggacagcatggtgtgaaacccatctctttaaaaaaaaaaaaaaaaattgaattagctgcacacgtggtgctgtgcacctgcagtcccagctactcaggaggctgaggtgggaggatcacttgagccttggaggtcgaggctgcagtgagccatgatcacaccactgcaccccagccagggcgacagaatgagatcctgtctcaaaaacaaacaaaaacaaacaaaaaaaaaaaaaacattgcgagggaagaaatacctcactttggccttgttgggggcagatgtgggaggatttggggtcacagtggttctcttggtgttggtccctgtttcagaagcctcccctccctctcactgactctgtttctttccatcattcttggtctttgtctctctctctcttttttttttttctttgaaatggagtctcactctgttgcccaggctaaagtgcagtggcgagacctcagctcactgcagcctccacctcccaggttcaaccgattcttcagcttcaacctcccaagtagctgggattacaggtgcacatgccaccacacccagctaatttttgtatttttagtagagacagtgtttcaccatgttgaccaggctggtctcaaactcctgacctcaagtgatctgtccacctcggcctcccaaagtgctgggattacaggcgtgatccaccgtgcccggccagtctttgtctctttgtatctctctctctccatctctctctgtttctctcttcctcttccccatctctccacttgatctctctctcactggacctccttgtgtgagtgagcatcacctctccattccccagtctctttctgtctctgtctcatttcctttccccatcttctctctatccctctctccatctgggcctctgtgtacatgtctttgggtctgtctgtccgtctgtctgtctgtatccttctcactcactcattcattccctcggtctctgcccccattctctcttggtccccggggtccccacagatgctgaatctctttgtcgccgtcatcatggacaactttgagtacctcacccgagactcctccatcctgggcccccaccacctggatgagtacgtgcgtgtctgggccgagtatgaccccgcagcttggtaagaagtcaccccgaatcctccagccacaatactcacctctccctggaactggaacacgggctaggtcaggccccagactctggagcactgaactcctggggtcctagcaggggtctcacaggttcagtcaggagagaagatataagaatcatcacccttgcataccccagattaaacacgtagggtgccaaccctgcccaaaccctggactttctgggaaatgagggagggcgtcaaccatgagatgtcctgaagagccctctcctcctacgagtctctcctgtctctcactgtgaagtctccagatggtgaggatgcattagccaggctccagggagaaaaccaacagcatcccagcctcagttctcttgagagtgtggggaggagggctggcctacccttggcagacaggattggcagcaacatcagagtagcagaactcagctcccactgggacccgtgaacctgggagtgagaggacatacaggccaggggaggacgcagagcctcaggggcccatgcatctttgtggccacaaagggagtgggcgctcccatctgggtagacaccagaggggtccctctccactgacgggcaatggtttcagagggtgggttccaccttgtgcacgtgtattgagtgcccacccaacaccaagccttgaaggacactcagaggctttatctgaatacctggaacccaccagccactaactgaggatttagttcaggctggtcttggggcctgaagaagcattactggggggccctcagcagcctaagccccatcttcctctggcctcagcaccagagaggaggccgtcacgaggaaggtgggcaggaggtggtcttggctattcccatagcctcaaacaagtactccatgagaccgagaggctggggagagccgtgggtctggggctgggctttggctggttcctaactcttcctcttttgattttaggtcacagcaattggatgctgtccccaaggcctctattccacaagcccccccccacccctgtagcccatgtagactgtggaggaggcagatgcagagagagccccaggggaggtgccctgcagtcccgaactcgactgacatcctacacccctgggtctccccagtgtctgggaatgtactggggaccttcacttgtccccagtctctcccactccttcaagccagggacaccccagcctcgggcatcatgacctcgctgtgtgcccagggagcccgtgtgaacccattgcctgcactaaccccctttcttctcctttcagcggtcggattcattataaggatatgtacagtttattacgagtaatatctccccctctcggcttaggcaagaaatgtcctcatagggttgcttgcaaggtttgacttccactaaaacctgctagcatccatggaatgagtgtggcttggggttcttcaatatatatatttcatatatatatatatatatatctctctctctctctaaaaaaacagagccatctctctttcttgcattaaactagaaaactctcttagccaacagaatgcagtcatgtagactcgataaagcatggaacatatttcctccttcccttcagccttcagccatctttgcttgctcttagctgaagctgcccatcctggggtctccacggcaccccaaatcagatacatcccctgggggattgtaactttgcatttctcccccaaccatcacctccactctctccccctccacccctcacctcccaaagcccctagccctcctcccctccctggcactggcccctgctccccacctaggccccctcagagaccagcctcagccaaaccagagaacgtgacccaactgtagaaataacagtgatggccgggcgcagtggctcatgcctgtaatcccagcactttgggaggccaaagcaggaggatcgcttgagcccaggagtttgagaccagcctgggcaacatagcaagaacccccttctctataaaaaattagccaggcattgtggcgcatgcctgtagtcccagctacttgggaggctgaggcagaaggattgcttgagcccaggaggtggaggctgcagtgagctatgatcacaccactgcactccaacccaggcgacagagagagaccctgtctctttaaaaaaaaaaaaaaaaaaaaaaaaaggcaatgaacaaaagcatggctctacgtcttccaaagtgagaattctccctcccctccgcatccctccagaactgtagctcagagcccacgctgaatctgacttttctcttttctctctctctccctgctcccgagcagtgaagtaatctttttttactgaccttttcttccattttttttcctcctcttttccattgatttgaaatatctattttatcattctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccaggggccgcatgccttacctggacatgtatcagatgctgagacacatgtctccgcccctgggtctggggaagaagtgtccggccagagtggcttacaaggtagactacccttgccgaccaccgacgtccaggcactgggtttttttttcttcttcttcttctttttttttagtgctgaccagaaacacccggccgactctctttttccaacgtttctcttcttttttgtttttgattcttttttttcttttctcgagtcaactgatcatgaccatcccttgattctaagcagcacactgtgtccgtcctttctgatgagtgtcttcgtgttttgagactccattatggccgacatgccggggggagggggaggggagcgcccaggtccccttgcacctggtctcccaggtaccaaattggaaacaaacacgcttcttcagggagtcaaaacccatgcttcccacttctgcccacccagagcggcccccatgcccaggctggggcaggcgccttgcagagaggggctttagcccccgaaagcaggcgaggtcccgggtccccgcccctgccacgcacacctgaagctgatctctgacctagggccttggggattcgagaccttccaaggagcaccaagaacctctcttcccctcccttccttcccctggagtttcgtccccagcccccgtccctaatccccccaagacaccccaacatgcctctccattgttccagagtgggcaggcggccgcagctggacccctggacggtggcacactgatgcaggccatgcacgctgccttggcggggcctggggcgggcaggcaccatggccgacggggggtggtgcatgctggctgagagagcgagcgtcctgccgccaagcggctggcccgggccacccctccagatccctgtcctggaatctcccttggtgcccaaggacagatgctctgttccctccattcatccacaagaagttcagggatgacctttaaagattctccccacccaaaaagtattaccccatcatcctattctcccatccaccttgatcttccctgcgtccctatccatcaatgctatttgtacctgccccgtgttgccacctcattcctttccttcctctgtgcacccctcctcacctaacctatatgtctcccctccttctcaatcaaagccggggacaaggttgtcccaccagcatctcagacaatgagcctctcctggcacctgtcgctctgtgcccctccctgccgcccccccccccccccccggttttcctcaagtcgcttctctcagtctctgcttagatgaatgtgtgcgcatgtgcaagagagggagggcgagcccttcctctcctggtctttgtgcaggaccaccatgggtccataagacaactttgtgcaaatttgaaaaaggcaccctttccacagaacatgcctgttggaaaattgttgcaatctaccaatgtggtgagaacaagacactttttttctatcacctgggaagctgttatatttaatatacaaatcgggggctgggcgtggtggctcatgcctgtaatcctagtgctttgggaggctgagacgggaggatcacttgagcccagttcgagactagcctgggcaacatagcgagaccccatctctacaaaaagaaaaaatattttaattaataaataagtacataaatctatcatttccaagatgggagccctttgtgcggtgtacaacctgcacaactgtgcacagtggcccagtctatgtgtgtttctctatttcccacctccttccccaccctacccccagtgtcccctccagtgtcctgctctggatttaccatacccctccccatcttcaactctgtgtttcctgcccacttgtgtctgaatccccacccaagttgccctcaccccccttctctgtgccacttcagcctgggctggtgcacaccagcccagcatcctctcccatgccaccaagcatggtggacagagcccctgcctgggacatggggaatcttttcttccctgggctggaagggagtgcccctcaccccttccccctgccattgcacagagagccaagatctggacatgcccctgagatacacttcccacggagctatgaatgagtctcgagattccgtctgcatgcgcccctgtctgtgctgttctgtgtcacagcctcgctgcatgcctgcgaggggcctgccccgtcagtggggggctgcctgcctgctgcttctcagaggaatgatgtggtctgtgcccatctgctctgtcctggtctgggccaagccagggattgggtgtggggagccagtggcaccccccaccagcggctgtggtcctggccccctcagccttggctgttgcatgcactgctcaaatccagcttgtgctctttttctttggggtcagactgaaacggggccatccagaagaactctggggcagggcgggggtggggcaagggttgaggcaaaccctggaaatgccagctctcaggtcaagcaggtgggggaaaaaaggagagggcaggggaccagaagtacaagagagccttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagggtaaggaagggacaggggcgggcacagacaggcgtgacagggtggaaccggggatctccctccctaccccaaactagaggatctgctgtcaccacccggatcttcattcactcttccattcattcgttccacagggttttttggggtttggggttttggtgtttttttttttttttttttgagacagagtcttgctctgttgcccaggcagcagtgcggtgacatgatcgcaagtcactgcagccttgacctcccaggctcaagtgatccttccacctcagcctccccagtagctgggactacaggcacacaccaccatactcggctaatttttttttttttggtgtgacaatttccctctgtcacccaggctgaagtgcagtggtgtgatcttggctcattgctacctccgcctcccgggttcaagcgattctcctgcctcagcctcccaagtagctgggattataggtacccaccagcacacccggctaattttttatattttgggtagagatggggtttcaccatgttggccaggctggtctcgaactcctgacctctggtctcaaactcctgacctcaagtgatccacctgcctcgacctctcaaagtgctggattacaggcgtgagccaccatgcccaacctaattttttatattttttatagagatggggtttcatcaggttgcccaggctggtctcaaactcctgggctcaagcagtcctcccaccttggtctcccaaaatgctggtattacaggcatgagccaccacacccggcccatttggcagatatttagtgcactccttcaatgtgccagagacccgtccaagcaggggaggacccagcagcttacactttagatggatggggaggccgccactgaggaggtaaggcagtgtctcatggatccctggggggaaggtgctccaggcagaaggactggcaaaggccctgacagaggggtgaacacaggacacccggggcattgagctgactcaccttctgagtgagggcacgccacgcaggttcagagcagaggaggaacctgacccaactcacatttgaacaggttccctccggccactgaggggatgggagaccgaaaggaggccagtgtgggggctgctgatatcatctgggtggagacagggcggcagcttagatctaggggtaggctcgacgtggtggctcacgcctgtaatctcagcactttgggaggccaaggtgggtggattacttgaggtcaggatgaccagcctggccaatgtggtgaaacccccgtctctactaaaaatacaaaatttagccagacgtggtggtgggtactgtagtcccagctactagggaggatgaggcagaagaatcgcttgaacctgggaggcggaggttgcagtgagccgagatcacgccactgcactacagcctgggtgacagagcaagactctgtctcaaaaattaaattaaattaaattaactggacatggtggcatatgcctgtggtcccagctactcaggaggcagagatgagagtattgcttgaagccaggagtttgaggctgcagtgagtcatgatcgcaccactgcactccagcctgggcgacagaacgagatcctagctcaaaacaacagaaagaaaaagaaaaaaacattttttttaaagctgagaaggggctgggcgcagtggcttacgcctgtaatcccagcactttgggaggccaaggtgggtggatcacgaggtcaggagttcaagaccagcctggccaacatggtgaaaccccatctctaccaaaaatacaaaaagtagccgggtgtcatggtgggcgcctgtaaccccagctactccggaggctgaggcaggagaatcacttgaacctgggagacagaggttgcagtgagccaagatcgcgccactgaactccagcctggatgacagagcaagacgctgtctcaaaaaaaaaaaaagctgaggccgggcacgctggctcacgcctgtaatagcagcactttgggaggccgaggcgggcagatcatgaggtcaagaaatcgagaccatcctgggtaacacggtgaaaccccttctctactaaaaatacaaaaaattagctgggtgtggtggcacgcacctgtagtccctgctactcagaaggctgaggcaggagaattgcttgaacccgagaggcagaggttgcagcgagccgagcttgtgccactgcactccagcctgggtgacagagtgagacttcatctgaaaaaaaaaaaaaaaaaaagccgagaaggctggacatggtggctcacacctgtaatctcagcattttgttgaggccaggcacagtggttcacgcctgtaatctgagcacgctgggaggccgaggtgggtggatcatttgaggtcaggagttcgagatcagcctggccaacgtggcaaaaccctgtctctactaaaaatacaaaaattagccgggtgtcgtggcgtgtgcctgtaatcccagcactttgggaggctgaagcgggtggatcacttgaggtcaggagttcaagaccagcctggtcaacatggcaaaaccctgtctctactaaaaatacaaaaattagccaggtgtggtggcgggtacctgtaatcccagttactagggaggctgaggcagaagaatcacttgaacccgggaggcagagattgcagtgagccgagatcacatcactgcactttagcctgggcgacagagcaagactccatctcaaaaataaaaataaaaataaaaaataccgagaaattcccccaaagacctagctcagggctcactctccatcattagggggaaagaagaagaggaggccagggaggcgggcagagaccagggcagtgtgggctcctggaggcagcttctatgtttaaaagggcggcttcaggaggaaggggaccaaccgtgtcaggcactgcccagagaccaaggatgacaaggatcacaagtgactggtcatcatggtcactttgaccagtgcagctttggcggaggggtcaggggtcccctgtctggagtgcatttcggaggcccgaaaggggatgtgatgtgatttggcagctgattaaggacagcagggcagagagacaggcgcacaattgccagaagaaacggggacctgaggctcacgcctgtaatcccagcactttgggaggctgaggaaggtggatcacttgaggccaggaatttgagaccagcctggccaacatggcgaaaccccatctccactaaaaatacaaaaattagccaggcatggtggtgcacacctataatcccaacaacttgggaagctgagcacaagaattacttgaacctgggaggcagaggttgcagtgagccgagatcaaaccattgcactccagcctgggggacacagcaagactctgtctcaaaaaaaaaaaaaaaaagaaagaaagaaagaaaagaaaaaacaaatgggaccagaaaaaaggagtgggtgggagaggagcaggtggatagtcccacacatgggaaggtgctgagcccagctgaaaccactagtaagtcaggaggagggaagactgagcctcgagacatatgtgccttccagggtcttgagggaaagaagggaggaagagccaaggccacgtggcaagactcaaggaggaagtggcagggaaggtgggggactggaggggtggaggacagatattgttaatgccaggaacaaagtgaaggtaaagagagcacaaggaagttgggagcagtggctcacacctgtaatcccagcactttgggaagccaaggcaggaggatcacttgaggccaggagttcaagatcagcctggccaacacagagagaccccatctctacagaaaattttaaaattagccaggtgtggtgatgtgcacctgtagtcccaactacttgggaggctggagtgggaggatcactggggactgggatgtcaaggctgcagtgagctatatgatgaccacagacatagcagcttaagacacacctatttgtcagctcacagtcctgtaggtcagaagtccaaaaagctggactgggctgtctgctgagggtctcacgaggctgaaatcaaggtgtcagccaagctgggctcctctctggaggatctgggggagaatctacttccaggttcattcaggtgttggcagaattgaagtccttgtggctgtaggactgaggtcttgttttatcactggctttttagctttttgctcctggaagtgcatgtaatcctccatgtgctctcattctctctgacttccccatctgccacccagcagagacaatactgtgcttttcaagggctcacctgattggggcaggcctaccctgatcatctctgtattttgaggtcagctgacttgatattttttttttttcttgagacagaatttcactcttgttgccaaggctggagtataatagtgtgatctcagttcactgcaatctccgcctcccaggttcaagcaattctcctgcctcagcctcctgagtagctgagattacaggtgcccaccaccacgcccagctaaatttttttgtatttttagtagagatggggtttcacaaggttggccaggctggttttgaactcctgacctcaggtgatccacccgcctcagcctcccaaagtgctgggattacaggagtgagccaccatgcccagcattttctttctttttttttttttttttgaaacggagtcttgttctgtcacccaggctggagtgcagtggcgcaatctcggctcactgcaacctccatctcccgggttcaagtgattctgcctcagcctcccaagtaggtgggactacagatgcgtgccaccacgcccggataattttttgtatttttagtagaaacggggtttcaccatgatagcaggatggtctcgatctcccaacctcgtgatctgcccacctcggcctcccaaagtgctgggattacaggcgtgagccaccgcaccgggcctccggtattttaattatatctgcaaagtcccttcatagcctgggcaatggtccctagattagtgtttgaataaacagaatcttggcagaagggcagcttttgaattctgcctaccacagttccttcgtttgtacaacgggtctaacaacacccccactctttgtatgtaatgccatcgtaactcagcttctgtggcactctgagaatctgtgttcaggggtcccaaaaccacccacaggttcagtgattccctggaagaactcagaactgagaaaagtttttatactcacagtttattacagtgaaagaatatagattaaaatctgcaaagggccgggcacggtggctcacgcctgtaatcccagcactttgggagggcgaggtaggcagatcacttgaggtcacgagttcaagaccagcctgaccaacatggtgaaaccctgtctctactaaaaatacaaaaattagccaggcgtggtggctggcgccagtaatcccagctacttggaaggctaaggtaggagaatcacttgagcccaggaggcagaggttgcagtgagccgagatcccgccacttcactccaggctggacagagtgagactctattagaaaaaaaaaaaaaaaaaaaatctgcaaagggcctggcatggtggcttacgcctgtaatcctggcactttgggagggcaaggcgggcagatcacttgaggtcacaagtttgagaccagcctggccaacatggcgaaaccccgtctctaccaaaaatacaaaaattaggcatggtgccagacccctgtaatcccaactactcaggaggctgaggcaggagaatcgcttgaccctgggaggcagaggttgcagtgagctgagactgtgccattgcactccagcctgtgtgacaagatcaaaactctgtccaaaaagaaaattagccaggtgtggtggcatacacctgtagtcccagctactccagaggctgaggcacaagaatcctttcaacccaggagatagagctacattaagccaagatcacgccactgcactccagcctgggcaacagagcaagactctgtctcaaacaaacaaacaaattccaaaaacataaaatgcgcaaaggaagggcatctggggaagggtccaggagacaccaggtgcgagcttccagttgtctgcctccagtggagttgcacagacaacgcttaattctccctgcagtgtgtgacaacacgcaccgtgtactgccaaccagggaagctcacctgagccttggtgccccagggtttttattgagggtttgtcatataggcagggctgacgtagttactcagtctccagtccctccagaggtcaaactgataccacgtggcccaagaccccaacgataaatcgcattgttagaatgaactgtatggaaaattatccaggcgtggcggcgggcggctgtaatcccagctactggggaagctgaggcaggagaatcacttgaaactaggaggccgaggttgcagtgagccaagatcgcaccattgcactccagcctgggcaatagagcaaaaacaccatctcaaaataaataaataaatagaatgaactgtattggccgggtacagtgactcatgcctataatcccagcactttgggaggctgaggctggaggatcgtttgaggccaggagttcgagaccagcctaggcaacatagtgagaccctatctcttttttttaaaaaaaaaaaaaaaaaaaaaaaagaatgaactatacagtgtggcccaaggccccctgctaaataaagacactcttcaggcaggacatttcaaaggcttagagatcacctcccaggagcaagtcaatgggccagtcctttcatcggaatgtgcagggtttggacaacactagcctactgagctagtccttactgcttagcaccccagcttctatgacacctactggattcccttcctgagggtttcaaagactcctggagatgtctctgaatttggctgtcacagttgttacttgtaccccagatgccactcagttccctgaagacaatgatcccccagatttctcagccaggagcccctccacctcttgtcctcagtgggtgccaggcctcatcctggagttccacagctgagccaggctctcggggttacggaaggtcaagagggtgtggggacaacaatggaagagtgataacagtggcagccctttgagcagatgcgggtctcaggagaacataacgcgctttcttttcatagttcagctcactttctaagcacactgagcttcctttccagcaggctaaggggctgcaaagggggtacagattaacctcattcttcagattctcaaaaatggtgtcaccattcattgctggagactgggagaaagggggcaagtccatctcattctctctgtctctgtctctctctctctcttccctgtccatctgtttctctctcccacccacccctctgttctctctgcccagaagaatctctattttggttttggttttgtttgttttgtattgttttgagacggagtctcgttctgtcgcccaggctggagtgcagtggcgcagtctcaactcaccactgcagcctccacctcccaggttcaagcgattctcatgcctcagcctcccgagtagttgggattacaggcgcacgccaccacgcccagctaatttttgcatttttactagagactggtttcaccatgttgaccaggctggaccctatcctctttcaagccccccaccccaggcattgagggcagagccaactacctgcctgaaccaattagcatattaaacgtaaacccagttagcatatccaaatagcagcccacagtgacattctgactgtcagaatgtggattgcttgagcccaggagctcaaggcttcggtgaacaaagattgtgccacagcctgggcaacagagtaagtccctgtcgatcgatagatagatgatagatagatagatagatagatagatagatagatagatagatagatagataaatttttaaaaaaaataataggccaggcacagtggctcatgcctgtaatcccagcactttgggaggccgaggcaggcagatcacctgaggtcaggagttcgagaccagcctggccaacatggtgaaaccctgtctctacaaaaatataaaaatagccaggcagatgtctgtaatcccagctactcaggaggctgaggtaggagaatcgcttgaactctgaaggtggaggttgcagtgagccgagatcatgccattgcactccagcctgagtgacagagcgagactccatctcaaaaataataacaataataaaaataataataaatgctctggccccaaagtggcacattacatggtgcacaccccattagcaaggactcatcacatggccctgccaaccacaggaggaacccccccatgtactcaggtaggagggccaggaaacaccgtcagagagctttaatgactcaccccatgactggggtgagggacgagggactggctgcaggccaagggcatgtccgtggcagtggagacttgggaaaggggaaaagacctcctctgagccacgcacagtggctttcatctgtaattccagcactttgggaggctgaggtgggaggatcttgagcccaggaggtcgagactgcagtgagctatgtttgtgccacggcactctagcctgggcgacagagcaaaaccctgtctcaaaaatcaaaataaaaccaaaaccaaaacttcctctgttggggatgctccagggcgtcccagccttgaacagatgggtcactgcagtaataatcctatggcagacactgtcccaaggctgcacgcacgttactttgatcatcaaacaaccaggtgatagccaggcatggtggtgcgtgcctgtagtcccagctactcaggaagctgaagcgggagaatctcttgaacctgggaggcggaggtaacagtgagtcgagatcacatgactgcacttcagcctgggaacagagagagactctgtcaaaaaaaaaaaaaaaacaggccagacgcggtggctcacgcatgtaatcgccagcactttgggaggctgaggagggtggatcacctgaggtcaggagtttgagaccagcctggccaacatggtgaaaccccgtctctactaaaaatacaaaattagttgggcgtggtggtgcacacctgtaatcccagctactcgggaggctgaggcaggagaatcgcttgaacccaggaggcagaggttgcagtgagctgagattgcaccattgcactccagcctgggcaacaagagtgaaactccatctcaaaaaaaaaacaaaaaaaaaacaaccagccaggcgcggtggcttacgcctgtaatcccagcactttgggaggccgaggcgtgtggatcacccgaggttaggagttcgagaccagcttgaccaacatggtgaaactccgtctctactaaaaatacaaaaaattagccaggcatggtggtgcatgtctgtaatcccagctactcgggaagctgagacaggagaattgcttgaacccaggagtcggaggttgcagtgagccaagctcgtgccactgcactccagcctgggcaacagagcaagactctgtctaaaaaaaaaaaaaaaacacacacacacacacacaacaaccaggtgaggcaagtactcttgctatcatctccatttcacagatggagaaactgagttactaagtggtagagtaacctaagtcatgcagccgataactgggagacaagattgggacccaggtcgcccagctgttctccatgccgggctgtctcctgcacagctgctccatggtcctggccccaccgaaaaccagagcccacaaggtcattccagcagcactgcccagggcctcctctgggccaggccgttggggaactggagaccccatggggaccagaaagattggggtctcgttctcgggagcctatggctttgcagctgacccagagtccagctgacacccaggcaggcagtcagggtctgtctacacccccattgcaggaggagccgacaaacagcagatggacgctgagctgcggaaggagatgatggcgatttggcccaatctgtcccagaagacgctagacctgctggtcacacctcacaagtgtaagagctgagcccagccctgggatccaatccaccaggacagatggagggggagggaaaggggaggcctggggagagtgttggcctgggctggtatacacagggacccaggacaagggccccaaagaggcctgcccttggtgagctcaccgtgtgtgtgcccccagccacggacctcaccgtggggaagatctacgcagccatgatgatcatggagtactaccggcagagcaaggccaagaagctgcaggccatgcgcgaggagcaggtgcgctgttcgccgctctggggacatctgggctggggacagtggcttgcatgtcaccacgggaaccaactggaatatgagggtggctgagccccagggcaggtccctgaaaagtaggggctgtgcacagcagctcacacctgcaatctcagtgctttgagaggccagggcagagggatcgtttgagaccaggatgagaccaccctgggcaacacagtgagactccatctctacaaaataaaacattagccaggcatggtggtgcacacctgtagtcccagctatttaggaggccaagatgggaggatcacttgaggccaggagtgggagaccagtctgggcaacatagaaagacccatatctctacaaaaaaaaaataaaattagctgcatgtggcgccatgcacctgtggtcccagctacttgggaggctgaggcaggagaatcacttgaacctgggaggtggaggttgcagcaagccaagatcaagccactgcactccagcccgggtgataagagcaggactctatctcaaaaaaaaaaaaaaaaaaaaaaaaaaaagttcttgccaaggacacatcatgtggattcattcttcattcagctgctccaccaacacttattgagtattactgtgtgcagggcgctgttctcagtcctcggggatgcacccatggggaaaataggccagaatccctgccctcagggagcagacattccaagtggggaaatgccaatggtagcaaatgactgaatcgtgcaacatccagcaaagagaaagaaagtgtcgtgggggaaagtggagaagaatccagaagataggagtatccaggggaggaggggatgcggtgggaaatgggtagttggggagcctccctgagaaagtgacatgtgagcaaaggcttgaaggaaaaggggagagggagtgagctaagcaatacctggaagggtgttccaggcagaggaaacagccagtgcaaaggctctgaggctggaccgtgcctgggttgtttgggtaacagcaaagaggccagtgtggtggaaaagagcagggaggagacaagggcaaggaggtgacagggcagatccttcagggccatgggagctgcaggaaggactctggctttttccccaagcaagtgggagccatggagggttctaagcaaaggagggataggacctgactcaagtgctcatgggcgccctctggtggctcttgtggaacagtggggttgaaggtaggagcgggagacctgggagaaggtgcctgcagtgagagatgaggacgtgggaccaggctggggctatgacttgggtggaggagtgagaagtggtccagttctgcgtggaattggaagggtctagatggatgagacctgagagagtgtgtgtgtgtgtgtgtgtgtatactggggatgtcgcaatgccttctgggtaccaccgtcccaccaccccacccttgtccacacactgctctctgccccattccccaggaccggacacccctcatgttccagcgcatggagcccccgtccccaacgcaggaagggggacctggccagaacgccctcccctccacccagctggacccaggaggagccctgtgagtgtcacccctgccagggaggtggagtgtgggggtgccgtggtccccacgttctggaagctgcccaagcgcccactgctaccccggcctctgtcccccatgcaggatggctcacgaaagcggcctcaaggagagcccgtcctgggtgacccagcgtgcccaggagatgttccagaagacgggcacatggagtccggaacaaggcccccctaccgacatgcccaacagccagcctaactctcaggtgcctctgtcccccaactccccaatggctcccagggcccgggtggttcaggtggaagggatctgggccccccacacacacacacctgcagctccctccctctgcagacaccagggatctggaggtcaggccccagagctcatctggctttgccatctgctccgcagtccgtggagatgcgagagatgggcagagatggctactccgacagcgagcactacctccccatggaaggccagggccgggctgcctccatgccccgcctccctgcagagaaccaggtgagggctttcaccactgccctggggctggacccctcactctgcactgggtagggccaggcccccccacaagcagcccagtgcatcccctccctgccggactcaggcctgggtagggactccttcagtctctgaagcagtctgcaggccccacccaccacctggtcacacctggagcacctgcagaccctcctccctcacagaggacagagaggaaagtgctccccctggggcagagggcagtggccactgcaaaatggtctctggctgccctggttggaggctgcagacaggggaggttgtggaagatttgtgggtgcagcagggttcaacagggccagctgagacctgccacgaagatcacccctacacaaacacacacacacatgctcaacatacatgcacacacatgtgcagctgtgcgcctactcagatgcttgcatacacacacgtgtgtgcacgtgggcatatacacactgcacatgtactcacacatgcacacatgtacgtgcacacgtgtctgcatatgggaacttggcaggtcctaggatacagtagcagagtctggggtgggtctgggggcagctgggctcgtattttctgtctggtctctgtgggagtcattggggggcacaggggtgtgtgcttgatgtgtgtctgtgtgtggccgcttcacccagctgccaggcccacctgcaggtgatcccgttgccttggactcatgggacagagggcccagaggcatagctggctgcccacccggcctgaacagcgggggcccatgcacgcagcccgcctctggaggagaacagggcatggctgtgagagcctggcccgggtgcgtggcatgtgtggctgtggcgagctttccgtgtgccgtgtgtggcgtctgcacggggcaggaggctgtgctgtgcctggctggaccagggtcacctgagggcctggcctctggctgctgggaacgtgggttggggagcacccagcgtgcatgctgctgctccctcaggaccgagctgctgggccccaggagagggttgggacaagcccagctgacggccaccacatggaagctttgagcatcggccggagccaggggttggggtgtgcatcgcatgaggcagagcccagggccaggggctcgaggctgcgccgtcctgtctttcggtcccatgcctctgccatttgtctgtctgcatctcctgtctgtctcctctgtacccatgggaatagaggacgcccagccccgggggcctgggacacccacccgccaggactttaacttttcttttcctccctgccttctccctccgatttctcttgatgccagtgccactcccctccttggcttcttctccatgcaccacctcctcactctccctcttgccttttatatttattttcttctttctgttttttctgtgtgcaccatcccatggggctgtgacagaggagaaggggccggccacgtgggaataacctcagtgtatgtaccgcgcctgcccagcgcccagcagggctccggccccctcttcctccccaccccccctccagggagtcccgtcatctctcaccgtccccggaccccaccctttctttggcaatcgcaccctctcccctccatggagcccaatccttgtgtgtggtgtcctgtgtgtgcccctcacccataagccctggtgggcggggccatccccatcctcacccctacccccttttcttcagggccccccacgccggaggacactggctctccaagagcctggcccactctgcacctctttctggggggcttcttctcctgacaccaccaccaacccctggtcctgcagctcctacctggagcagggccaccagcgctcagctgggctggaccctgggaggcgggcgtctgccccatctccctccttccctcctctgcctgctgcagagaaacctgtgtgtcagggcttgacccagggatgaagcaccagggaaaagagtgggcccccagagcctccagtgcctgggtatcccccacccccacccagagctccctagcttgggcctcaccagaaggactcagacttgtgggggcagcgagcacagccccgttagccgggaggacccaaagctgccatgccgggcacctggtcctgagcccataggtcagccagccacagtcggaggcttctcaccctcccaggagagcaagctggggcagggatgagtgcggcagtccagggctcccaggtttgcaccctggatgtggagagggcttccctctggccagcctgagcctgcccaactgtggctgggcccccaggactggagagtgaggatcagatctttctggtcagaacccaggatgggctcaaaaggagcagtcctgtctctgagggacagaggaatcctcaggctccaccctcagaggcctggccacacccagagccctgattgatcagggggagccaaggccccatggcatcccctggcccctgccccaggatggtcacaccgcagtcaccgaaggccaccaccaggctgccacaatggggcaggaaggaccgggaccacttggtgctagctgctgaccccagcccaccggcctgtcccctcccccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggtgggcagccctgtggtgctcagggacaagcagaacagaggagaggagaggggaggagaaggcagggcggaggagacactaaggaagaagaaagggagaggcctccatggagaggggacagagggggccaggcagcagctgcaggaacctgggtactaccccctccccccaacccactgacctgcctcggttcaggggatctctagggcccccacaccttccaggtggcctcctgtgtgtgcatctgccccacctctccctcacgaccacctgtgtgtctgtctgaccctcacccggcccaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcaggtgggtgcggctgcaagtgaccccaggctgggctcggccgggaggcggggaggagagaaggggataccccatccaacagccactctaggcaaaggtccccggatcccggctgtgaccacctcccatcctgcccccaagccaccggggtgcccggcggccggagcggacacggatccccaccacaccagctgcctatgctgtccccccagcccccttgcccacccgccgccccctccccgccgcccgcagctgcttgctcctcggttgtggatcatatttgagttctgggccgtgccgcccgacctttcactttcctttaacccggcttctgtttttgtttcaattatgatttctgtcctctggacgcctgtgagtaatttttgaaacttctgctatttttaaccccgaaacttacaaaactccatttctcatttctcttttcactttgttgtgttggttttcgactcctcccctccctgtctcactccccctcctcccctccctcctccctgtggctgttgcttttttccattcaatgtcctgtgtcccccctctcctcctcctcctcctcctccccctccccctcctccctctcctcccggcccctctcccttcgctcccctctcttcctcccaatcccgtgtctcctttgattttgttgtatctttttttttgatttcctttgtttcaattttcgtgtagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 2 - protein, 2506 aa, Homo sapiens
  ref <308>: DATABASE ACCESSION NUMBER: NCBI / NP_001120694.1
  ref <309>: DATABASE ENTRY DATE: 2013-09-14
  ref <313>: RELEVANT RESIDUES IN SEQ ID NO: (1)..(2506)
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 3 - protein, 547 aa, Homo sapiens
  ref <308>: DATABASE ACCESSION NUMBER: NCBI / NP_001120694.1
  ref <309>: DATABASE ENTRY DATE: 2013-09-14
  ref <313>: RELEVANT RESIDUES IN SEQ ID NO: (1960)..(2506)
MIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 4 - DNA, 8628 bp, Homo sapiens
  ref <308>: DATABASE ACCESSION NUMBER: NCBI / NM_001127222
  ref <309>: DATABASE ENTRY DATE: 2013-09-14
  ref <313>: RELEVANT RESIDUES IN SEQ ID NO: (1)..(8628)
gatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatgctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 5 - DNA, 1010 bp, Homo sapiens
  ref <308>: DATABASE ACCESSION NUMBER: NCBI / NM_001127222.1
  ref <309>: DATABASE ENTRY DATE: 2013-09-14
  ref <313>: RELEVANT RESIDUES IN SEQ ID NO: (5101)..(6110)
tgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagcc

SEQ ID NO: 6 - DNA, 78 bp, Homo sapiens
tcacacctcacaagtccacggacctcaccgtggggaagatctacgcagccatgatgatcatggagtactaccggcaga

SEQ ID NO: 7 - DNA, 25 bp, Homo sapiens
acggacctcaccgtggggaagatct

SEQ ID NO: 8 - DNA, 25 bp, Homo sapiens
agatcttccccacggtgaggtccgt

SEQ ID NO: 9 - DNA, 1010 bp, Homo sapiens
ggctgcgtagatcttccccacggtgaggtccgtggacttgtgaggtgtgaccagcaggtctagcgtcttctgggacagattgggccaaatcgccatcatctccttccgcagctcagcgtccatctgctgtttgtcggctcctcccttggcaatcttgatgtccagggctgtgcggatcagagccatgagggtggaattgaagtggacggtgttgtcatctgcgacgggcaggtccatccgcagaagccgcttgtaagccactctggccggacacttcttccccagacccaggggcggagacatgtgtctcagcatctgatacatgtccaggtaaggcatgcggccccaagctgcggggtcatactcggcccagacacgcacgtactcatccaggtggtgggggcccaggatggaggagtctcgggtgaggtactcaaagttgtccatgatgacggcgacaaagagattcagcatcagaaacgagcagaggaagatgaaggaaacaaagtaaaaataagcaaattcattgccacactctcgagtcaggatgccagagttcttatcacacggtttcccgctgaggcaggaaagcatgatgttgtgccaagcttccccggtggcactccggaagagaagcatgagggcctggaagaaggtccggaagttattgtgctcagtgatttggaactcatcttcatcactgtcctcgtcctccacgtcgatgccaatgttaccaaacacctgcatcccaatgatggcatagatgaagaagagcatggcgatcagcagacagacataaggcagggccttgaaggactgcacaaaggtccagagaagaatgcggatggtgtaaccctgacggagaagtttgatgagccgggcagctcggaagaggcggagaaagctcaggttgatgaagttattcccaaactcagtcacgaggatatcggtgatgctgcccagaacagtcacaaagtcgaagatgttccaggcatcgcggaaataattca

SEQ ID NO: 10 - DNA, 78 bp, Homo sapiens
tctgccggtagtactccatgatcatcatggctgcgtagatcttccccacggtgaggtccgtggacttgtgaggtgtga

SEQ ID NO: 11 - DNA, 25 bp, Homo sapiens
agatcttccccacggtgaggtccgt

SEQ ID NO: 12 - DNA, 1644 bp, Homo sapiens
atgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaa

SEQ ID NO: 13 - DNA, 28 bp, Artificial Sequence
  Synthetic primer
atacccatggtggctgcgtagatcttcc

SEQ ID NO: 14 - DNA, 28 bp, Artificial Sequence
  Synthetic Primer
aatgaattcctcatggctctgatccgca

SEQ ID NO: 15 - DNA, 29 bp, Artificial Sequence
  Synthetic primer
aatgaattctccaggccctcatgcttctc

SEQ ID NO: 16 - DNA, 29 bp, Artificial Sequence
  Synthetic primer
aatgaattctgaattatttccgcgatgcc

SEQ ID NO: 17 - DNA, 28 bp, Artificial Sequence
  Synthetic primer
atacaagctttggctgcgtagatcttcc

SEQ ID NO: 18 - DNA, 28 bp, Artificial Sequence
  Synthetic primer
aatacgcgtctcatggctctgatccgca

SEQ ID NO: 19 - DNA, 29 bp, Artificial Sequence
  Synthetic primer
aatacgcgttccaggccctcatgcttctc

SEQ ID NO: 20 - DNA, 29 bp, Artificial Sequence
  Synthetic primer
aatacgcgttgaattatttccgcgatgcc

SEQ ID NO: 21 - DNA, 28 bp, Artificial Sequence
  Synthetic primer
cgtatctagagatatagtctatggatgg

SEQ ID NO: 22 - DNA, 29 bp, Artificial Sequence
  Synthetic primer
gtaggccggcctctatcttgtgccagatc

SEQ ID NO: 23 - DNA, 29 bp, Artificial Sequence
  Synthetic primer
ataggccggcctggctggtgctaaccaca

SEQ ID NO: 24 - DNA, 30 bp, Artificial Sequence
  Synthetic primer
cgctggccggccccaagataagaaacaatt

SEQ ID NO: 25 - DNA, 44 bp, Artificial Sequence
  Synthetic primer
cgtatctagagatatagtctatggatggatcatctggatagatt

SEQ ID NO: 26 - DNA, 44 bp, Artificial Sequence
  Synthetic primer
cgtatctagagatatagtctatggatggatcatcgcctaatgga

SEQ ID NO: 27 - DNA, 44 bp, Artificial Sequence
  Synthetic primer
cgtatctagagatatagtctatggatggatcatcttacgctgga

SEQ ID NO: 28 - DNA, 19 bp, Artificial Sequence
  Synthetic primer
ctggccaacatggtgaaac

SEQ ID NO: 29 - DNA, 18 bp, Artificial Sequence
  Synthetic primer
ccgggttcaagcgattct

SEQ ID NO: 30 - DNA, 19 bp, Artificial Sequence
  Synthetic primer
ccgggttcaagcgattctc

SEQ ID NO: 31 - DNA, 32 bp, Artificial Sequence
  Synthetic primer
ataaggatccagccaccatgcagaagacgcta

SEQ ID NO: 32 - DNA, 100 bp, Artificial Sequence
  Synthetic primer
gtatctagattacttgtcatcgtcatccttgtagtcgatgtcatgatctttataatcaccgtcatggtctttgtagtcgcaccaatcatcgtcagtctcg

SEQ ID NO: 33 - DNA, 41 bp, Artificial Sequence
  Synthetic primer
aattgctagcgatgttccagaagacgggcacatggagtccg

SEQ ID NO: 34 - DNA, 64 bp, Artificial Sequence
  Synthetic primer
aattatcgatctattagtgatggtgatggtgatggcaccaatcatcgtcactctcgctgtaggg

SEQ ID NO: 35 - DNA, 20 bp, Artificial Sequence
  Synthetic primer
tgacagtgccatagtttgga

SEQ ID NO: 36 - DNA, 24 bp, Artificial Sequence
  Synthetic primer
aagtgtaaatagtgcaaattcccc

SEQ ID NO: 37 - DNA, 20 bp, Artificial Sequence
  Synthetic primer
aagaccatcatggccaacat

SEQ ID NO: 38 - DNA, 19 bp, Artificial Sequence
  Synthetic primer
ttggctcaacacaacctcc

SEQ ID NO: 39 - DNA, 21 bp, Artificial Sequence
  Synthetic primer
tctagccctccttgcctggaa

SEQ ID NO: 40 - DNA, 21 bp, Artificial Sequence
  Synthetic primer
tggaggttgaatttggaaatt

SEQ ID NO: 41 - DNA, 22 bp, Artificial Sequence
  Synthetic primer
gtgtccttcatctccaagttcc

SEQ ID NO: 42 - DNA, 22 bp, Artificial Sequence
  Synthetic primer
gaagcctgaacaactcctgact

SEQ ID NO: 43 - DNA, 21 bp, Artificial Sequence
  Synthetic primer
atgccccaggcctcttgctgt

SEQ ID NO: 44 - DNA, 21 bp, Artificial Sequence
  Synthetic primer
gggtagctcacagcaggtaga

SEQ ID NO: 45 - DNA, 21 bp, Artificial Sequence
  Synthetic primer
tggcatcatatttaccctgct

SEQ ID NO: 46 - DNA, 22 bp, Artificial Sequence
  Synthetic primer
tttcttcttgtcatctgcatcg

SEQ ID NO: 47 - DNA, 21 bp, Artificial Sequence
  Synthetic primer
gattggactgagcagtcagga

SEQ ID NO: 48 - DNA, 21 bp, Artificial Sequence
  Synthetic primer
tcttaacctgatacagtcatc

SEQ ID NO: 49 - DNA, 17 bp, Artificial Sequence
  Synthetic primer
acttccagctgctgccc

SEQ ID NO: 50 - DNA, 18 bp, Artificial Sequence
  Synthetic primer
atacagcaggtggcggag

SEQ ID NO: 51 - DNA, 20 bp, Artificial Sequence
  Synthetic primer
ctactgtgggaagctcaggc

SEQ ID NO: 52 - DNA, 20 bp, Artificial Sequence
  Synthetic primer
gggaaccaccttctctcctc

SEQ ID NO: 53 - DNA, 20 bp, Artificial Sequence
  Synthetic primer
cccaggaccagtgaagaaag

SEQ ID NO: 54 - DNA, 20 bp, Artificial Sequence
  Synthetic primer
aaagaggaaggggcaatgat

SEQ ID NO: 55 - DNA, 21 bp, Artificial Sequence
  Synthetic primer
gccggtagtactccatgatca

SEQ ID NO: 56 - DNA, 28 bp, Artificial Sequence
  Synthetic primer
atgatgatcatggagtactaccggcaga

SEQ ID NO: 57 - DNA, 21 bp, Artificial Sequence
  Synthetic primer
tgatcatggagtactaccggc

SEQ ID NO: 58 - DNA, 28 bp, Artificial Sequence
  Synthetic primer
tctgccggtagtactccatgatcatcat

SEQ ID NO: 59 - DNA, 21 bp, Artificial Sequence
  Synthetic primer
gccggtagtactccatgatca

SEQ ID NO: 60 - protein, 2266 aa, Homo sapiens
  ref <308>: DATABASE ACCESSION NUMBER: NCBI / NP_000059
  ref <309>: DATABASE ENTRY DATE: 2014-05-24
  ref <313>: RELEVANT RESIDUES IN SEQ ID NO: (1)..(2266)
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 61 - protein, 2512 aa, Homo sapiens
  ref <308>: DATABASE ACCESSION NUMBER: NCBI / NP_075461.2
  ref <309>: DATABASE ENTRY DATE: 2014-05-24
  ref <313>: RELEVANT RESIDUES IN SEQ ID NO: (1)..(2512)
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 62 - protein, 2261 aa, Homo sapiens
  ref <308>: DATABASE ACCESSION NUMBER: NCBI / NP_001120693.1
  ref <309>: DATABASE ENTRY DATE: 2014-05-25
  ref <313>: RELEVANT RESIDUES IN SEQ ID NO: (1)..(2261)
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 63 - protein, 2263 aa, Homo sapiens
  ref <308>: DATABASE ACCESSION NUMBER: NCBI / NP_001167551.1
  ref <309>: DATABASE ENTRY DATE: 2014-05-05
  ref <313>: RELEVANT RESIDUES IN SEQ ID NO: (1)..(2263)
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 64 - DNA, 2717 bp, Homo sapiens
  ref <308>: DATABASE ACCESSION NUMBER: NCBI / NM_153480
  ref <309>: DATABASE ENTRY DATE: 2014-02-26
  ref <313>: RELEVANT RESIDUES IN SEQ ID NO: (1)..(2717)
cgagggctcctgctggtactgtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaagaaaaaaaaaaaaaaaaa

SEQ ID NO: 65 - protein, 667 aa, Homo sapiens
  ref <308>: DATABASE ACCESSION NUMBER: NCBI / NP_705613.1
  ref <309>: DATABASE ENTRY DATE: 2014-02-26
  ref <313>: RELEVANT RESIDUES IN SEQ ID NO: (1)..(667)
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 66 - DNA, 2338 bp, Homo sapiens
  ref <308>: DATABASE ACCESSION NUMBER: NCBI / NM_033260.3
  ref <309>: DATABASE ENTRY DATE: 2014-05-10
  ref <313>: RELEVANT RESIDUES IN SEQ ID NO: (1)..(2338)
ctcaacgtcgaaccgaaggcgacacccacccaactcctccctctccgccccatagtccacccaacacttgcagcccctccagagaaaaagcccagcggaagaggactccggaaaagtgactatctcggaagaccagggtagagctcccgggagaaaaaggcgaagatccccggccccggatcgccatccccttccctggcaccagcttctctaggctgcgcgaaggaagagggtacgacgccggggagggactgggtgcgcgggcatgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaacagcccggccgcgggcggcggcgccagagatacgcagggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgccgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctcagtccgccgccctggcccgcacctgccgtacccggtggagacgctcctagcctgagtagcgccgcggggcccgggaacgccgagtgcgcgccgtcggggaggcgggaacgcgggcccgcgcgcggactttgcactttgaatccagaggaagatgaatttttaaaatctccatcaaacgtgccttaaagctaaagcattttgacaggagtatttaaacttagtccaggatattttcctttgtgttttataactttacagaggaccaaagcaattcttgttttagtttctttgcgaagcctgctcctccttcccttcataaggactttttttgtctttctttaacgcccaggcttcgtcttatttctactgtttttgtcgcaacttccattgatttatgtcccttccctcccccctaagtacatcagggaacctttccacactataaatgatatgactactgtttggggtttctgggcccccatccgtgtacgtatgtggcatttccaggtatgactgagtgtgagagacatgtcagaggctcttcagtgatttcttgctattgaccgatgcttcactgtgccaaaagagaaaaaaaatgttgggttttgtaattaaattatttatatatttttgaaacccgaattgaaaatgttgcaggcaacgggctacagctttattagtggttctctaactgtggtctccttgggccaagcaatttctttaaaggaaaagttgattatgtatgtggggtgccaggaccactgccttgaaagcaagtgtgatttttatttttaatattattttatttgtgtctgtgtacatattcatgtataaattttatgaaacccaagcatagtgcttattttttaataaaacaactgacttaacacattgtgaaaaaaaaaaaaaaaaaaaa

SEQ ID NO: 67 - protein, 403 aa, Homo sapiens
  ref <308>: DATABASE ACCESSION NUMBER: NCBI NP_150285.3
  ref <309>: DATABASE ENTRY DATE: 2014-05-10
  ref <313>: RELEVANT RESIDUES IN SEQ ID NO: (1)..(403)
MKLEVFVPRAAHGDKQGSDLEGAGGSDAPSPLSAAGDDSLGSDGDCAANSPAAGGGARDTQGDGEQSAGGGPGAEEAIPAAAAAAVVAEGAEAGAAGPGAGGAGSGEGARSKPYTRRPKPPYSYIALIAMAIRDSAGGRLTLAEINEYLMGKFPFFRGSYTGWRNSVRHNLSLNDCFVKVLRDPSRPWGKDNYWMLNPNSEYTFADGVFRRRRKRLSHRAPVPAPGLRPEEAPGLPAAPPPAPAAPASPRMRSPARQEERASPAGKFSSSFAIDSILRKPFRSRRLRDTAPGTTLQWGAAPCPPLPAFPALLPAAPCRALLPLCAYGAGEPARLGAREAEVPPTAPPLLLAPLPAAAPAKPLRGPAAGGAHLYCPLRLPAALQAASVRRPGPHLPYPVETLLA

SEQ ID NO: 68 - DNA, 2974 bp, Homo sapiens
  ref <308>: DATABASE ACCESSION NUMBER: NCBI / NM_000909.5
  ref <309>: DATABASE ENTRY DATE: 2014-05-10
  ref <313>: RELEVANT RESIDUES IN SEQ ID NO: (1)..(2974)
gtctgtgtcgaataatgtgtggcttctgttggattgcttttctttccaaaattcctaggcaatgcttccccgaggtgtgcacctttgtgaggtgtttgtggggttgggggagcttcaggcgctactcgcgggacgccgtcacgtgatccgggatgaggtggagttcggctttaaggaggcgtctcttcctagcttcatcaatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattactattaactgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtctgaagtcattcagaagtggtttgaggtttctgttttttggtggtttttgtttgttttttttttttttcaccttaagggaggatttaatttgctcccaactgattgtcacttaaatgaaaatttaaaaatgaataaaaagacatacttctcagctgcaaatattatggagaattggggcacccacaggaatgaagagagaaagcagctccctaacttcaaaaccattttggtacctgacaacaagagcattttagagtaattaatttaataaagtaaattagtattgctgcaaatagttaaattatatttatttgaattgatggtcaagagattttccattttttttacagactgttcagtgtttgtcaagctttctggcataaatatgtactcaaaaggcatttccgcttacaatttgtagaaacacaaaatgcgttttccatacagcagtgcctatatagtgactgatttttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttcaaaaaaaaaaaaaaaa

SEQ ID NO: 69 - protein, 384 aa, Homo sapiens
  ref <308>: DATABASE ACCESSION NUMBER: NCBI / NP_000900.1
  ref <309>: DATABASE ENTRY DATE: 2014-05-10
  ref <313>: RELEVANT RESIDUES IN SEQ ID NO: (1)..(384)
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 70 - DNA, 3947 bp, Homo sapiens
  ref <308>: DATABASE ACCESSION NUMBER: NCBI / NM_003654.5
  ref <309>: DATABASE ENTRY DATE: 2014-05-05
  ref <313>: RELEVANT RESIDUES IN SEQ ID NO: (1)..(3947)
gggggtggagccgggaccgcagcgcctgccgctcgctcggagctgtagccgccgctgccgccgctgctcttggctcggggacgcgggcgggcgctccgagaggctctggtgcctgcggctgctgctctcctccggcgcccggggctgcggcgctccgggtcccggcccctgtcccggcatctctcgggtccctgagccccggccccgggtcccgcgtccggccggagagaacgcactcagctgctcgagccgccccgggctcgcgcccccgggccatgaagaggggcccgtgaggcgcgcgcggagtcggaggaagaggagggaggagggaggccgaggaggagggcgcgggaggcggaggatgccgccgcggctgctgccgccgccgccacccgcgggtccccggcgaccctgactccagacccgaggatggagccggcgctgggcgctgcagctgctcccggcgcgtccccgaccaggtagctggtgtcacttcggtgtggttggaagaagactttctccccagctgcattcccggaggcgccctttcgacctggaggccgggtctgctggccacagggctgccgcactggctgggactgccagctgggcctggagacgctggtggctgtggactccccagcttggagcagtccctctttgacctcaccccttggagaagcagccccatgaaggtgcccagccatgcaatgttcctggaaggccgtcctcctccttgccctggcctccattgccatccagtacacggccatccgcaccttcaccgccaagtcctttcacacctgccccgggctggcagaggccgggctggccgagcgactgtgcgaggagagccccaccttcgcctacaacctctcccgcaagacccacatcctcatcctggccaccacgcgcagtggctcctccttcgtgggccagctcttcaaccagcacctggacgtcttctacctgtttgagcccctctaccacgtccagaacacgctcatcccccgcttcacccagggcaagagcccggccgaccggcgggtcatgctaggcgccagccgcgacctcctgcggagcctctacgactgcgacctctacttcctggagaactacatcaagccgccgccggtcaaccacaccaccgacaggatcttccgccgcggggccagccgggtcctctgctcccggcctgtgtgcgaccctccggggccagccgacctggtcctggaggagggggactgtgtgcgcaagtgcgggctactcaacctgaccgtggcggccgaggcgtgccgcgagcgcagccacgtggccatcaagacggtgcgcgtgcccgaggtgaacgacctgcgcgccctggtggaagacccgcgattaaacctcaaggtcatccagctggtccgagacccccgcggcattctggcttcgcgcagcgagaccttccgcgacacgtaccggctctggcggctctggtacggcaccgggaggaaaccctacaacctggacgtgacgcagctgaccacggtgtgcgaggacttctccaactccgtgtccaccggcctcatgcggcccccgtggctcaagggcaagtacatgttggtgcgctacgaggacctggctcggaaccctatgaagaagaccgaggagatctacgggttcctgggcatcccgctggacagccacgtggcccgctggatccagaacaacacgcggggcgaccccaccctgggcaagcacaaatacggcaccgtgcgaaactcggcggccacggccgagaagtggcgcttccgcctctcctacgacatcgtggcctttgcccagaacgcctgccagcaggtgctggcccagctgggctacaagatcgccgcctcggaggaggagctgaagaacccctcggtcagcctggtggaggagcgggacttccgccccttctcgtgacccgggcggtgcgggtgggggcgggaggcgcaaggtgtcggttttgataaaatggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccccccccattcagacacatggatgttgggtctctgtgcggacggtgacaatgtttacaagcaccacatttacacatccacacacgcacacgggcactcgcgaggcgacttctcaagcttttgaatgggtgagtggtcgggtatctagtttttgcactgtcttactattcaaggtaagaggatacaaacaagaggaccacttgtctctaatttatgaatggtgtccatcctttccccatccctgcctcctgcccctgacgcccatttccccccttagagcagcgaaactgccccctcctgcccgcccttgcctgtcggtgaggcaggtttttactgtgaggtgaacgtggacctgtttctgtttccagtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataatctctgtgtgtgattgcaggacattctgaatgggtacgagagggcctcagccgggtctgggtgttcctagctttggggaggacagcgagagagaggtggaggtgggaattaaatgacaagtctgcctttcagaactcttgtcaccctcaacactgagtttagtttaggtttttgttttgttttgttttgagacagagtctcgctctgtcacccaggctggagtgcaatggcgccatctcggctcactgcaacctctgcctcccaggttcaagcagttctcccgcctcagcctcccgagtgactgggactacaggtgcacactgccacacctggctatttttttttttttttggattttagtagagacggggtttcaccgtgttgtccaggctggtcgcgaactcctgagctctgggcattcctcctgcctcagcctcccaaagtgctgggattgcagacttgagccacctcacccagccgttttttttttccttcagtcagttgagaccgggtaacttatagccagggataatgttcaaagtctttaacaagtggtatggcttgctgaatcagagtagctggaggtaagaatgacatcctggaatcccttcttgtgctaaatgttacccatttagttggtgggtctgggtctaggatagccagggagggggaaacttcaaggggtggggtgcctcagggcagtggctgctgacccacagacctggaagtatttgactatttgaataactggtacaggtttactggtgtctacactggcagagaatctgctgtgcttcctccccttcccttcgtggcaatctagcaggttgctccaggcagcttccccagctcttattccaagaaaacctgcccctggggtggctgcaggtcacagctttgttgtcctgggacaaaggagtgtctggtgattaggcagccccaggggtcctagccaactggaagaagggcttcctgaggaaacacagtcctgggctattttatatgtgtcaggaggatgtagacagttcaacagctctagcaaatgccttaactaatagtggcttaatcaagataggtgattttcttttgtaaaaaattttactggggtaaaataacagaatgtaaaatttaccatcttaacctttttaaggtgtaccattcattaaatacattcacaacgtgtgccaccaaaaaaaa

SEQ ID NO: 71 - protein, 411 aa, Homo sapiens
  ref <308>: DATABASE ACCESSION NUMBER: NCBI / NP_003645.1
  ref <309>: DATABASE ENTRY DATE: 2014-05-05
  ref <313>: RELEVANT RESIDUES IN SEQ ID NO: (1)..(411)
MQCSWKAVLLLALASIAIQYTAIRTFTAKSFHTCPGLAEAGLAERLCEESPTFAYNLSRKTHILILATTRSGSSFVGQLFNQHLDVFYLFEPLYHVQNTLIPRFTQGKSPADRRVMLGASRDLLRSLYDCDLYFLENYIKPPPVNHTTDRIFRRGASRVLCSRPVCDPPGPADLVLEEGDCVRKCGLLNLTVAAEACRERSHVAIKTVRVPEVNDLRALVEDPRLNLKVIQLVRDPRGILASRSETFRDTYRLWRLWYGTGRKPYNLDVTQLTTVCEDFSNSVSTGLMRPPWLKGKYMLVRYEDLARNPMKKTEEIYGFLGIPLDSHVARWIQNNTRGDPTLGKHKYGTVRNSAATAEKWRFRLSYDIVAFAQNACQQVLAQLGYKIAASEEELKNPSVSLVEERDFRPFS

SEQ ID NO: 72 - DNA, 941 bp, Homo sapiens
  ref <308>: DATABASE ACCESSION NUMBER: NCBI / NM_006744.3
  ref <309>: DATABASE ENTRY DATE: 2014-05-11
  ref <313>: RELEVANT RESIDUES IN SEQ ID NO: (1)..(941)
cgcctccctcgctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgaaaaaaaaaaaaa

SEQ ID NO: 73 - protein, 201 aa, Homo sapiens
  ref <308>: DATABASE ACCESSION NUMBER: NCBI / NP_006735.2
  ref <309>: DATABASE ENTRY DATE: 2014-05-11
  ref <313>: RELEVANT RESIDUES IN SEQ ID NO: (1)..(201)
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 74 - DNA, 1861 bp, Homo sapiens
  ref <308>: DATABASE ACCESSION NUMBER: NCBI / NM_000304.3
  ref <309>: DATABASE ENTRY DATE: 2014-05-26
  ref <313>: RELEVANT RESIDUES IN SEQ ID NO: (1)..(1861)
aataaactggaaagacgcctggtctggcttcagttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcact

SEQ ID NO: 75 - protein, 160 aa, Homo sapiens
  ref <308>: DATABASE ACCESSION NUMBER: NCBI / NP_000295.1
  ref <309>: DATABASE ENTRY DATE: 2014-05-26
  ref <313>: RELEVANT RESIDUES IN SEQ ID NO: (1)..(160)
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGLCVMSAAAIYTVRHPEWHLNSDYSYGFAYILAWVAFPLALLSGVIYVILRKRE

SEQ ID NO: 76 - DNA, 710 bp, Homo sapiens
  ref <308>: DATABASE ACCESSION NUMBER: NCBI / NM_002962.1
  ref <309>: DATABASE ENTRY DATE: 2014-02-08
  ref <313>: RELEVANT RESIDUES IN SEQ ID NO: (1)..(710)
tcccacacttctgaggttttctttccaggacagcctggtttcccttcttcggcttattgttccatcagatttcagattttgagttctgatttttggtcagaagagtaaagtttctgggattggggacgtgtgtgctatgggaactcagtgtgtccccagcccttgtttgtaaacaaggaagggacagagatcagggaaataaaggcagaaggcagtgagagggaggctatgcctgctgcttggattctctgggctcactcccacagtgagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggagatgaaggagagcagcatcgatgacttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgcaggtgctggga

SEQ ID NO: 77 - protein, 92 aa, Homo sapiens
  ref <308>: DATABASE ACCESSION NUMBER: NCBI / NP_002953.2
  ref <309>: DATABASE ENTRY DATE: 2014-02-08
  ref <313>: RELEVANT RESIDUES IN SEQ ID NO: (1)..(92)
METPLEKALTTMVTTFHKYSGREGSKLTLSRKELKELIKKELCLGEMKESSIDDLMKSLDKNSDQEIDFKEYSVFLTMLCMAYNDFFLEDNK

SEQ ID NO: 78-79 - skipped (2 entries)

SEQ ID NO: 80 - DNA, 922 bp, Homo sapiens
  ref <308>: DATABASE ACCESSION NUMBER: NCBI / NM_005855.2
  ref <309>: DATABASE ENTRY DATE: 2014-03-16
  ref <313>: RELEVANT RESIDUES IN SEQ ID NO: (1)..(922)
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaacttggaaaaaaaaaaaaaaa

SEQ ID NO: 81 - protein, 148 aa, Homo sapiens
  ref <308>: DATABASE ACCESSION NUMBER: NCBI / NP_005846.1
  ref <309>: DATABASE ENTRY DATE: 2014-03-16
  ref <313>: RELEVANT RESIDUES IN SEQ ID NO: (1)..(148)
MARALCRLPRRGLWLLLAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 82 - DNA, 512 bp, Homo sapiens
  ref <308>: DATABASE ACCESSION NUMBER: NCBI / NM_002961.2
  ref <309>: DATABASE ENTRY DATE: 2014-05-04
  ref <313>: RELEVANT RESIDUES IN SEQ ID NO: (1)..(512)
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 83 - protein, 101 aa, Homo sapiens
  ref <308>: DATABASE ACCESSION NUMBER: NCBI / NP_002952.1
  ref <309>: DATABASE ENTRY DATE: 2014-05-04
  ref <313>: RELEVANT RESIDUES IN SEQ ID NO: (1)..(101)
MACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 84 - DNA, 5954 bp, Homo sapiens
  ref <308>: DATABASE ACCESSION NUMBER: NCBI / NM_004822.2
  ref <309>: DATABASE ENTRY DATE: 2014-03-06
  ref <313>: RELEVANT RESIDUES IN SEQ ID NO: (1)..(5954)
cttcgggggcgagcgcgcgtgtgtgtgagtgcgcgccggccagcgcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcgacgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctagcgccgaggcagcgggcgggcgggcgggcgggcgccagggcggggccgagcgagagcgggcgccttggcccggccgccgcggacttggcccgcgagggctttcccaggtggggggagggagggggcggggccgcacggcgcggggggcgggaccctcggcggcccctccccctacccccaccctgcgcgctctgggcgggagccgcgtgcacgcggggcggggtgcgccgccggccgggccctggagaaatgacgagacgtagctacctcacggggctccttccagagcagagacgcgcttccctgggcctgggcgcggccgccgtggaggggctgggggcagcctgccctggggcccgggggcgggcgcagaatcgcacaactggggccccaggcgcggggcgtggatggcgcggagacgtggacgggaggagaactgtgaattctcaagcccgtagtgtgggcggggcgcggagcacccaccaaaccaccacccgacacgcagccgacgggatccccccctttctccccggccccttctagcagttccccgcgggccacctggctgtcacagcctggactcctccatctgaaggggcctggcagcatttggggagtggacagctcctgtccagccagcatgccccaggcggcctctgtctccactgctacctgctgagtgggtcctactgggtgggggcttggggtcggtgagtggttcacctgtggagagaggagaggaagcccctgctgctgcctgtctctgcccctgcccctgcccctgcccagcgtggggctggcccatccggaaggcagtgggcccagggacacccctgagaagcccaagccgggtggtcaccgcctcatgctggagctgcctgttggaggaggcatcgcaaacgcaaaacctcccagagagtttccttttggaaacttggaaccagccctttttatgacgttttccagggggagggggaggggcactggctgggtttacggcagtgacactatttatgtaaatgacatcagctcccgcaaggcccctcagcaatgtcaacagctggaaagggcctgaacgggcttggagtctgcaggctgcgaaggcacttgggcctggcttggggccgggggcttgtttgagctgggatggggtttgctggctcagtgaagtaccagagtgcctgagccatgggtgggcaggggcacaggaatgaccaggttcctgggggccaaggaggccatgctggcttctccaagggaaggcacagaggctgccggcctgccccctacagctgtcttgggtctggcctgggccacaccttgaccgtgcctttccagacggtctttgtggagtctgcccgtgccctccactgtgccccagccctccttccaaaatctcctagagacacggtcctcaagcaggcagccccttttgttctgacctcctcacacagggtccattcctgtgccctggggcctcctggctccctgccttcctgggctctctgcactgcccgggcctctggcccacatcctcacacccggcgcactgaattaagaggcctggctcccctcacagtcaggaaattggtttcactttcccggccagagtttggctgctcaaaagggtcataccaagtatgaagctcggcccccggtggtctggcttccctccgccttccccacatttacccgcatcacggctgccatttattgagcacctgctgtgtgccaggcactttacccacatgctcccagtgtgtactcatgacaaccctgtgggacagggactcattatcaccagcaaggagactggagtacacgtgcccaaggtcatgctgcaaattggtggcaggactggggctcaaactccagagcccgactttctgaccaggggccacgctggccctcactgcactccagctctgcagcctacccgcccaatccctgtgcaggctgggagggtgctcttgggggagtggccaccgagcccctggccctggttactgcctcttgaggacactggcatctgggctggagaacaggagcccggggtggggtagggcatggggacaatcacatcttcagaggaggcagcaaagtggtgcgggatgcagggacggacttgccagatggcagctccaggttccaggaaggcaggccttggatgctccgaagaggtggtagaaaggtgtttttagaaaggtgttttggctgcctcagggtggttggagagactccaggagagactggcagaggtgcctcaggggcagggagcagacagacctgccctgggaaggggcatttggcttccctgaatccagcccaaggctagaagacagggcccctctccaagctgtcagcgcccctcggatgcccagtgtggtgtgctgggcgccatcagcatcacaaggcactacgctgctggggcggttgtcctatttctgtctatgccagtgtggtttcttcaccctgcccagaagggctgtggcagccccacgatatcccaccctgggtctgggtctcacgggtgtcctgtgaggggcttgcatttgtggtggtctctgaggccacctcagcaacggagctggcgacacgccaagcaacaaggcatcttgcggaaaattcagccagtgtcctgcccctcccttcggctcagcaccccgcagggcacaggctgtccgcccggtggtctggcccttggggaatgcgtcagggtgaccagatccaccatgctagcagccaggtcactgttgggattgcacggtcgtcacgagctgcctttcctatccacacacccagccaggacccagcccaccactcccgactgcagccccggcctctgcggtgagcaccatccttgggaaagcacccctcctccactccggtgccccactccaaggagcagagggaaatgggaattgaggtgtcccggtttgtacagttaggaagggatgtaaaacggaactagattttgattttgaagagtgtattaaccagaattgtgctatgtaggtgtttgtttgaagaaaaacataccagattagtctttgtttttgaaacagcttccccagttgtcctttttcttaccagctgggtggtctggtgcccctgacagctgagtgcctgctttacggacacgcagtaatgccgaagatttgcgggggaggacatagggctgtccccgggattcacctgctggctgtggtctctgcccactgcttctgtccttggaaagcagggcaggaggcagcatccccaggggcctctatgtgggagggagggacacctggggtcacaacccagggagggagggtcacagcccagggaggctgggagctgctccaaggccctggaactctgcctcagtcgcggcatgctggagaggggtacggacttactttcttggagttgtcccaggttggaatgagactgaactcaagaagagaccctaagggactggggaatggttcctgccttcaggaaagtgaaagacgcttaggctgtcaacacttaaaggaagtccccttgaagcccagagtggacagactagacccattgatggggccactggccatggtccgtggacaagacattcctgtgggccatggcacaccgggggggatcaaaatgtgtacttgtggggtctcgccccttgccaaaagccaaaccagtcccactcctgtcattggacgtttcttcccattccctcctcccaaatgcacttcccctcctccctctgccccctcctgtgttttggatttctgttcactcagaattgtaaatgtttagttgtgaccatgacgtattgtttgggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaatgtgggccccacatgatagaactaaattcagatatcattaaataaactcttgtacacta

SEQ ID NO: 85 - protein, 604 aa, Homo sapiens
  ref <308>: DATABASE ACCESSION NUMBER: NCBI / NP_004813.2
  ref <309>: DATABASE ENTRY DATE: 2014-04-06
  ref <313>: RELEVANT RESIDUES IN SEQ ID NO: (1)..(604)
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRDDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 86 - DNA, 1246 bp, Homo sapiens
  ref <308>: DATABASE ACCESSION NUMBER: NCBI / NM_007341.2
  ref <309>: DATABASE ENTRY DATE: 2014-02-26
  ref <313>: RELEVANT RESIDUES IN SEQ ID NO: (1)..(1246)
attttcctgacagatcccaaaatattcctgggccaatggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaaaaaaaaaaaaaaaa

SEQ ID NO: 87 - protein, 239 aa, Homo sapiens
  ref <308>: DATABASE ACCESSION NUMBER: NCBI / NP_031367.1
  ref <309>: DATABASE ENTRY DATE: 2014-02-26
  ref <313>: RELEVANT RESIDUES IN SEQ ID NO: (1)..(239)
MPLLLLGETEPLKLERDCRSPVDPWAAASPDLALACLCHCQDLSSGAFPNRGVLGGVLFPTVEMVIKVFVATSSGSIAIRKKQQEVVGFLEANKIDFKELDIAGDEDNRRWMRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGAEGEAEEEEETAEGEEPGEDEDS

SEQ ID NO: 88 - DNA, 859 bp, Homo sapiens
  ref <308>: DATABASE ACCESSION NUMBER: NCBI / NM_002925.3
  ref <309>: DATABASE ENTRY DATE: 2014-02-26
  ref <313>: RELEVANT RESIDUES IN SEQ ID NO: (1)..(859)
ggcgtctctgggaaggcagtggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggccaaaaaaa

SEQ ID NO: 89 - protein, 167 aa, Homo sapiens
  ref <308>: DATABASE ACCESSION NUMBER: NCBI / NP_002916.1
  ref <309>: DATABASE ENTRY DATE: 2014-02-26
  ref <313>: RELEVANT RESIDUES IN SEQ ID NO: (1)..(167)
MEHIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 90 - DNA, 1039 bp, Homo sapiens
  ref <308>: DATABASE ACCESSION NUMBER: NCBI / NM_145040.2
  ref <309>: DATABASE ENTRY DATE: 2014-02-01
  ref <313>: RELEVANT RESIDUES IN SEQ ID NO: (1)..(1039)
gttgcaggcagacggagcagagcggtcagggatcatgagggagagtgcgttggagcgggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggaggagggtgaagtcccagccagcgctttccagaaggcaccagagcccttgggcccggcggaccagtccgagctgggcccagagcagctggaggccgaagttggagagagctcggacgaggagccggtggagtccagggcccagcggctgcggcgcaccggattgcagaaggtacagagcctccgaagggccctttcgggccggaaaggccctgcagcgccaccgcccaccccggtcaagccgcctcgccttgggcctggccggagcgctgaagcccagccggaagcccagcctgcgctggagcccacgctggagccagagcctccgcaggacaccgaggaagatcccgggagacctggggctgccgaagaagctctgctccaaatggagagtgtagcctgagggctggtgttgcctgcctcccctgtgcttgtgccttgtcccaaaataaatcctttcagaatgtagcactcacgccctaataaggagcgaatcctacatccaccaaggcgggcgctctggccctcccttccttaagcccagtcctgtgtcctctgaaagaggtgcagtcactcacacctgcttgcgctcaccatcaataaaagtaatttcacccgaaaa

SEQ ID NO: 91 - protein, 261 aa, Homo sapiens
  ref <308>: DATABASE ACCESSION NUMBER: NCBI / NP_659477.2
  ref <309>: DATABASE ENTRY DATE: 2014-02-01
  ref <313>: RELEVANT RESIDUES IN SEQ ID NO: (1)..(261)
MRESALERGPVPEAPAGGPVHAVTVVTLLEKLASMLETLRERQGGLARRQGGLAGSVRRIQSGLGALSRSHDTTSNTLAQLLAKAERVSSHANAAQERAVRRAAQVQRLEANHGLLVARGKLHVLLFKEEGEVPASAFQKAPEPLGPADQSELGPEQLEAEVGESSDEEPVESRAQRLRRTGLQKVQSLRRALSGRKGPAAPPPTPVKPPRLGPGRSAEAQPEAQPALEPTLEPEPPQDTEEDPGRPGAAEEALLQMESVA

SEQ ID NO: 92 - DNA, 782 bp, Homo sapiens
  ref <308>: DATABASE ACCESSION NUMBER: NCBI / NM_004378.2
  ref <309>: DATABASE ENTRY DATE: 2014-02-02
  ref <313>: RELEVANT RESIDUES IN SEQ ID NO: (1)..(782)
aaggcgcgcagcgctgggcgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcaggagtttagccacttgggagaatgagaacaagatccactgcacgcaaactcttcttgaaggggacggccccaaaacctactggacccgtgagctggccaacgatgaacttatcctgacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggccttggtgcctcttgtatccctagtgctccatagtttggcatttgcacggtttcgaagtcattaaactggttagacgtgtctcaacctttaaaaaaaaaa

SEQ ID NO: 93 - protein, 137 aa, Homo sapiens
  ref <308>: DATABASE ACCESSION NUMBER: NCBI / NP_004369.1
  ref <309>: DATABASE ENTRY DATE: 2014-02-02
  ref <313>: RELEVANT RESIDUES IN SEQ ID NO: (1)..(137)
MPNFAGTWKMRSSENFDELLKALGVNAMLRKVAVAAASKPHVEIRQDGDQFYIKTSTTVRTTEINFKVGEGFEEETVDGRKCRSLATWENENKIHCTQTLLEGDGPKTYWTRELANDELILTFGADDVVCTRIYVRE

SEQ ID NO: 94 - DNA, 1477 bp, Homo sapiens
  ref <308>: DATABASE ACCESSION NUMBER: NCBI / NM_005525.3
  ref <309>: DATABASE ENTRY DATE: 2014-05-04
  ref <313>: RELEVANT RESIDUES IN SEQ ID NO: (1)..(1477)
gggaaattggctagcactgcctgagactactccagcctcccccgtccctgatgtcacaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttcttaaaaaaaaaaaaaaaaaa

SEQ ID NO: 95 - protein, 292 aa, Homo sapiens
  ref <308>: DATABASE ACCESSION NUMBER: NCBI / NP_005516.1
  ref <309>: DATABASE ENTRY DATE: 2014-05-04
  ref <313>: RELEVANT RESIDUES IN SEQ ID NO: (1)..(292)
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEFLYSTSYNMDRFINK

SEQ ID NO: 96 - DNA, 5734 bp, Homo sapiens
  ref <308>: DATABASE ACCESSION NUMBER: NCBI / NM_001201.2
  ref <309>: DATABASE ENTRY DATE: 2014-02-26
  ref <313>: RELEVANT RESIDUES IN SEQ ID NO: (1)..(5734)
agatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcccgggctccgtgcgccctcgccccagctggtttggagttcaaccctcggctccgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcagaaactcttgaaagaaaaggactgtatatcttcaatctgacatcgctaaccaagtctgaaaacattttgtctgccacactgtatttctgtattggagagctaggaaacatcagcctgagttgtccagtgtctggaggatgctcccatcatgctcagaggaaacacattcagattgatctttctgcatggaccctcaaattcagcagaaaccaaagtcaactccttggccatctgtcagtggatatggccaaatctcatcgagatattatgtcctggctgtctaaagatatcactcaactcttgaggaaggccaaagaaaatgaagagttcctcataggatttaacattacgtccaagggacgccagctgccaaagaggaggttaccttttccagagccttatatcttggtatatgccaatgatgccgccatttctgagccagaaagtgtggtatcaagcttacagggacaccggaattttcccactggaactgttcccaaatgggatagccacatcagagctgccctttccattgagcggaggaagaagcgctctactggggtcttgctgcctctgcagaacaacgagcttcctggggcagaataccagtataaaaaggatgaggtgtgggaggagagaaagccttacaagacccttcaggctcaggcccctgaaaagagtaagaataaaaagaaacagagaaaggggcctcatcggaagagccagacgctccaatttgatgagcagaccctgaaaaaggcaaggagaaagcagtggattgaacctcggaattgcgccaggagatacctcaaggtagactttgcagatattggctggagtgaatggattatctcccccaagtcctttgatgcctattattgctctggagcatgccagttccccatgccaaagtctttgaagccatcaaatcatgctaccatccagagtatagtgagagctgtgggggtcgttcctgggattcctgagccttgctgtgtaccagaaaagatgtcctcactcagtattttattctttgatgaaaataagaatgtagtgcttaaagtataccctaacatgacagtagagtcttgcgcttgcagataacctggcaaagaactcatttgaatgcttaattcaatcattagtttatttttatggacttcttcctgttttttttttttttttttttgcactgccaatgcattttgtttcaaaagattatttctatagtcagaggggaatgagcaaatagactgaagattgccaccaaggaaaagaactgtatttgtttctgaatgtaacttaaagcaagatttttagtaaatatggacatctatttctctttttgtaatcaaacacaacaacttatcaaactgtttttagaactgttagagaacacactggtttatttttgtaatgttctttgaaaacagaatggagaagcagcaatagcttgtcatttatctcatttaatgactaatgggaaatagagaacaatttcgcgttttgaattaggcttattgccttagaatcctgagaaagtgctaaataatcaactctgatgtttttcttaagttcttgagactcttgtttatccttgtttttcctccacaagtcattgtctaagtgtaatggaaagtttatgctgagcgttagtgtgtatgtatgtgcgtacatgcgccaggtgcctgtgccctctgtaggatggtttgcttaatatggttttataattcagtttacacaggattctttattttttttaattttgtattttggcaaacaccattcagttataagaactttgccaaatatgatagaataattcaagagcatatacagagagttaccacttgacccagctatttaattgcaaatacagttgttttcatttcatttcctaccagaaaaaggaatcagaaacctagtttttgaaaacacaagtgtaattcctcttttgtacttctttttcacaaatgcttttatttattctaaattgaatttaaaaatccttcctaaagccattaactctttaattctcctgatatgcctttacttcctatgaagttattggtagatgttgaggcccaaaaactggtagaatattgaagatcttcttaaatgaccaatttaaccataaccaaatattgaatatcattcttcagtcacatctaagtcaggcactttttcacatagatcagggcttttggctcagtcacgaaatctacaagttagcaaagcttacaaaacattattcgtcaggtatgggaatcaaatatagacacttgtttgtctttgctttccatttctatgtgtcacatacatatatgtgtcctcttataactttagtcttcaaaattatttcaatatccttcttctcactatatttatttgtgtgatggaaatgctttcaggccgtagatcattgttggtgttaatctgtggttaatcctcattttagttccgtcttatctgatacttagaaatatctcagccattttggaggctgtgcagtatcagaagacgtggagtttgttctgtctctgcctgtagctaattatggtggttcagtcatttaataaatatgttttgagcatctattttgtgaaaggcactgtgttacctgtgtgtctttagtgtcctcactggtaaaatgaagaggctggccatgagctggaagggttaagtttataattccagctatttcacacccgtcttccttgaaggaatgatagtgatagatataaaaacactgtaagtccctcttttaataaactaaatgaaagaacatcctatacttcgctgtttgtaaattagtatggcattcgctttggtttaagtggtattttattgcaaacccattaaaagaataactcatgaaaagaagctctttgacaccttggggtacacaaatgttggtgtgggtgtgtgttaattctgtgagtgagacacaccagttctaaaaaaaatgagtgaagttctggtgcctgagttaccatgctttcttctagttcttacagtagcataaaattaaagattcaaagtgagatggaggataaaattactttttaatacatgttctcaaacatttgaaaataaaagtatatgatagaagggggccagagtgtggccaccatcctgatcgtactgtttttcaataaagaaaactttttcattggtagatttggtgaaattctaaatttaggtttttttctagagctgtatcaaccaaaacttctggcaattcccagtatcacttcttagccttcttatatccaaatgcctgtttattacctttcttaatttgaatcaatgcctagttattacagattgcaccccacaatggccaaaaacccactacataataaaatttacaggtactaactagttaagattatattttaagtagcaattgatataaaattacaacacaatgaaagaacttgggtaatctcttagcaatggaaataggttttaaccagcagtttttctgggtgctttgtaactatcattttactaatgaattgaggatgtattatggtttaaattggaagagttttattcccaaagaataaagcaagattatctttcagtagtagagattgaagtaaatgtattaatattttaattaatacagatttactaagagtagttagaaaatttagtaagtgcctgttttacaaattgttaggtactagtttctgtataattcctacacagaagctttagaaatctcctgatattaaattattaaattggcattcatgaaaagagaagctacaattataaactccatttgctaaatcatgcataatactctctctctctcttcccccacaagtaatctctctaccccatgcagtgtgcacacacacacacacacagtcagttactgaaaaaaataattctttttctttttttttttaaatggagtttcactcttgtcgcccaggctggagtgcagtggcgtgatctcggcccactgcaacctccacctcccaggttcaagcagttctcctgcctcagcctcctgagtagctgggattacaggtgtccgccaccatgcctggctaatttttttatttgataaaaagaattctttttctcaataactgttctcttgaattcaaattaagggactgccaaagtcaattagaatattttaaaaatactttgttgtaacctgtgtaaataatatacaatttacaggatttgggattgtagaacttaaactggaagactggattcctcagatctcaggactataacattccagataaatttttacattccctttgctgtatattaactgatgatcatttatatgttaagattttttaccttaatatttctgaataaaactcttattgcccatttaatattttcataggcaatcaaatgtgagtaatactgctaagagtctgatttattaaaaatatttgtataattcattcagtttagtttttcagtttagtctttctgctttcacttttctctgtgctaacaagtaactaatgtctgggcattgacttcttattgaatcaaagttgggttaggcatagctatgcacacctgatgtgtaagattaaagaagagattaaataagaaatcttgggtaagttggacttttctgtatagctcttttttcctctgagttgtattttaatgtagtttataagtgataaaatgatccttgttttctaaaagccagtccttcccttcagctttccacagtttctgtaaatgtttaatacttgtacagtcaatggcaattttaaatatatatatatatataatatatgtatatggaaaaggttcaaagatgcttttaatttatttaatgactattgccttcctataataataattttcatccttaattatgataatacttttagcaagaaaaattcctttttactacagtttttagatgcaaaatgcagtttggttctttagtcaaatccacttagagggtatattgcagtgaaactgtgaaggatacttcactaccaatgtataagctttgttgaatttgtatcattttctttcagtaatgaaaagctattcattatacagtatggaaataaaaattgcttcattga

SEQ ID NO: 97 - protein, 472 aa, Homo sapiens
  ref <308>: DATABASE ACCESSION NUMBER: NCBI / NP_001192.2
  ref <309>: DATABASE ENTRY DATE: 2014-02-26
  ref <313>: RELEVANT RESIDUES IN SEQ ID NO: (1)..(472)
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQLLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 98 - DNA, 1784 bp, Homo sapiens
  ref <308>: DATABASE ACCESSION NUMBER: NCBI / NM_001099401.1
  ref <309>: DATABASE ENTRY DATE: 2014-05-24
  ref <313>: RELEVANT RESIDUES IN SEQ ID NO: (1)..(1784)
cgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcaatggagtttcgctcctgttgcccaggctggagtgcaatggagcgatcttggctcactgcagcctccgcctcccaggaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaaaaaaaaaaa

SEQ ID NO: 99 - protein, 462 aa, Homo sapiens
  ref <308>: DATABASE ACCESSION NUMBER: NCBI / NP_001092871.1
  ref <309>: DATABASE ENTRY DATE: 2014-05-24
  ref <313>: RELEVANT RESIDUES IN SEQ ID NO: (1)..(462)
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQWSFAPVAQAGVQWSDLGSLQPPPPRNLPHQTQIPQQQTTGKWYP

SEQ ID NO: 100 - DNA, 3150 bp, Homo sapiens
  ref <308>: DATABASE ACCESSION NUMBER: NCBI / NM_022138.2
  ref <309>: DATABASE ENTRY DATE: 2014-05-10
  ref <313>: RELEVANT RESIDUES IN SEQ ID NO: (1)..(3150)
gggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagtctccttgcaaatcttttccgttctgaattcagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactata

SEQ ID NO: 101 - protein, 457 aa, Homo sapiens
  ref <308>: DATABASE ACCESSION NUMBER: NCBI / NP_071421.1
  ref <309>: DATABASE ENTRY DATE: 2014-05-10
  ref <313>: RELEVANT RESIDUES IN SEQ ID NO: (1)..(457)
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTVSLQIFSVLNSDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 102 - DNA, 9682 bp, Homo sapiens
  ref <308>: DATABASE ACCESSION NUMBER: NCBI / NM_005504.6
  ref <309>: DATABASE ENTRY DATE: 2014-05-10
  ref <313>: RELEVANT RESIDUES IN SEQ ID NO: (1)..(9682)
agtagggaggtgggcaggagccagtgatgacggaatggcaatcacatttgacctctgatctgtttatttcctcctccttgacgtctccatataaatgttacacgggcatccccacactcggatacgcacccacagtggctgattcgggggtaaccgtgtcatttgcttgcaacactggcacctctgccctgcaccccgggagtgagcagtgagtgaggctcgggtctgggcgctggctccgaatcttcgggctgggagagactccaccatctgggggcggcctgggggagcagccttagtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttgtggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagacaaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccatattagttttgttgcttcataaaatttacctaagcaagtggtcttgcttgcctcaaatccaagcagtcttgaacacttggaggcaattaatgagtatatcttagtcaaaagaattgttggagctttttattaaagctacagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacattgtttgttcactttcaaagagtgatagtttctaaaacatttagagcaataaatattcatcagaggtaccaagtaagccggcagaagagttaagggttagagaaatcccttatttcatgtcttgactctaaaattatcaaagtacttttccttgtaatgtggatttcttcttatgcggatatgcaaaaacttcagttatacgtagtaatgctagcaggtaattttagtagacattttataacaactgtcactttgtttcgccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatggcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactattggattctggagaaaaatttaatgaaagatgatatcagaggaagaataagtggaggtagagaagaaaggaatgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgacttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatgaaatcagcattgttgaatgcatgaagtaataatgctaaattaacatttttatgatgtctcaaggtttctggtcaagggaagtaaatgtaggatagtatttttacaccaaaatgacacagagagaattgagcacaccagaaagaccagaaaccacaccactggatagagattcaatatgtttctttttcaaacatttggacaagaaaaaaatgggcatttaaaaattcttccttcccctggttatggatttatctgtagtaaaacttagctttgtcgtttgagatttgcacagaatggggggagtagattacctcttcccattcattgtcataatggatctacatcactgataaacaccatacttctatatgtggttaactagctttagaataaaagacactttaaaaagtaaaaggcctagagatcttcaatgaagtgtcccttttagccaaaccaggccttgcagaaattgtcctcaaaagcaccaagggagaacaaagccaagtgcagaattacccaagggtcacacattttgtattcattttcttataatttgcccaaatgatttgaagtacagcaaaacctgaagttttgcaaagagttactgtaaactgaacttaaaaatgtcagagtgctcggtgacccacttctccagaccctgtcaacctgtgaaaatattggcctttattcagatctctcaagaagttacgcgcagagtttggaaggtctaggcaaaggttattagtcaagtgttcttacagtgtcaacgctcaattcccacaagcgtgagaaagagagacctgtcattcctgagggtgatgacatacatttactggagcttatataatttatcagataagacagcagtttccttcagggtagaaagtgtgttttctacattgatttagtacaaaacaaaaagaaaaggggatatttcaaattttataattatttttctgctaagctgattcagtgtgatttaagcatatttttcaaatcatgaatctgattccatatacatatgtgccttatattgtgataatttatttttaagtgaaatatgctatcatagcctgactttatgtatagtggtgacaacttgcaggatcgcatttctgtaaccaaacggccgacagctgaggtgtagatgcttcctatggtctgtagaataatcactgggcttgttctctagctatgtctgtatgcaatcgcgacagtgttgatcaaaacccatgatcattctctccaaaggtctttgtcactaagccactagggattctgaaaagttcgtgagctgaaacaaataaattgagttggaagattaaaaaaaaaa

SEQ ID NO: 103 - protein, 386 aa, Homo sapiens
  ref <308>: DATABASE ACCESSION NUMBER: NCBI / NP_005495.2
  ref <309>: DATABASE ENTRY DATE: 2014-05-10
  ref <313>: RELEVANT RESIDUES IN SEQ ID NO: (1)..(386)
MKDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 104 - DNA, 3646 bp, Homo sapiens
  ref <308>: DATABASE ACCESSION NUMBER: NCBI / NM_003383.3
  ref <309>: DATABASE ENTRY DATE: 2014-05-10
  ref <313>: RELEVANT RESIDUES IN SEQ ID NO: (1)..(3646)
ctctccggccgccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatgaaaaaaaaaa

SEQ ID NO: 105 - protein, 873 aa, Homo sapiens
  ref <308>: DATABASE ACCESSION NUMBER: NCBI / NP_003374.3
  ref <309>: DATABASE ENTRY DATE: 2014-05-10
  ref <313>: RELEVANT RESIDUES IN SEQ ID NO: (1)..(873)
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 106 - DNA, 3868 bp, Homo sapiens
  ref <308>: DATABASE ACCESSION NUMBER: NCBI / NM_022912.2
  ref <309>: DATABASE ENTRY DATE: 2014-05-03
  ref <313>: RELEVANT RESIDUES IN SEQ ID NO: (1)..(3868)
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaaaaaaaaaaaaa

SEQ ID NO: 107 - protein, 201 aa, Homo sapiens
  ref <308>: DATABASE ACCESSION NUMBER: NCBI / NP_075063.1
  ref <309>: DATABASE ENTRY DATE: 2014-05-03
  ref <313>: RELEVANT RESIDUES IN SEQ ID NO: (1)..(201)
MVSWIISRLVVLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 108 - DNA, 9145 bp, Homo sapiens
  ref <308>: DATABASE ACCESSION NUMBER: NCBI / NM_145793.3
  ref <309>: DATABASE ENTRY DATE: 2014-03-16
  ref <313>: RELEVANT RESIDUES IN SEQ ID NO: (1)..(9145)
gctctcatctcaaagcgcgccctcccttccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtcttttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttctttggaaacacatccatgctgggatgcacagttcttttcctaaggattgtgtttactcctgactgcaacgtcttggccactgtttggagcagtttggtctgaaggtcattaaggatctgcttgcatcttgtttcatgtcctccgtgacagactgcagaccatgttagaagagaaggaaggtttgtggatcaagagggttgacattaggtttggtgagatgagttgcttggcacagatcagcagaacaggaccctggtgataaggcatctggctttgctaaccacttatcatcttccattattctctttcttaactaagtagacccgaaagtgcacttttgaagtctggtttagatggcgagattccgaatctacaatgatcgagtactggtggccacttttctccaacattaagtaaagaggaggagattccaccttcagaaagtgctgggaagcattggctttcttcccacattggtagaagagatggaggaggaaaccagggtgcacatttctacagatcccctttgcctgctggtgtttgccttgtaagataagtcactggggggaaggggaaatctatgaaatccaagataaaggcatagtctttcagctctattggtgttaaaagtatatttgtgtccaaatgttaatcaacacaaatgtacagtactcagtactgacttttttcacttcaaaatgttttcaagggaaattcagcagacacccaactgtatttaattagtgaaaagatctataaagactcttactttgaataaacacattaagtaagtgtgtcaaaatatttggaatgccagttatctatgagcgcatatctcttacagagtgtattttgttttcattaaggtatctctgtgtatctacactggactaatttcatagggatctgattctatgtgatccactgtagaaagctactgattacttctgcagtaacagcagctctaattagcatcagatgaccaaagcggaaatgggagtttcagcgctaacaagggcagccttcattgaagaatgcatgggtaggcaatatataaattacattttgaaaagcctcatctgtcaccaacaaatatctcatttttcttcagtgataaaagcatattcaagttaccagctcctcaatttgaaaatcagttgctgattaaataaatagggggaagcatcttgttcagggacaacacgttagagagattcttatcaaagcaagccaagcaaggtttccgccattcagtgtgatcttagtttgacacggtgaccctaaaacaccatcatttgccccagaactggagcacaataagttaaatcatttacctgtctcacttcttcttggcgtgcttaaaagcaaaaatgattcgctacttcctgtccttcagtccgggcatttggggtgccactgaagacaggggttatctgctgaggtttgggtgtcttgcaggaagtatctcattgcagttgattttgatgaaaccaaacagtaactagggtccatgcagaccgtgactccctgattacatctagccatgccctacttatttcagagagaaagagagggggaataaaggcagtattgccacactgattagaagcacattcattccactttgatgttgaatatttttgaccgatacatgcttgagtatctttttaatagagcacatgaaggaagaagcacacaatatagagaaggaattgagaatgccaattacatatttatttttccatacctgatttttttcaagtctgtaataaaaaaagtataagttgagattaacataggttatttttcatgaagtatagcaaacgatctagaatgtgataggagtgtggtttccatttctttttttttttttttaacagacttttgtgctgtagtaagaatgtcttagaagttgtgtcttcgagttcctcaaacaccggacagggctcccccagagctgcctcagcctttgatttggtccatattcagacacttcctgtcttgcatacactctgaggatgggccgcttctagctgccgcccgtctccctcttgccttcttgtctctaaatcagacactcccaagcactccatctgctatactaggagagtgggagagccaaagcattttggagtccatgtaaagtgcctgggaaaagagatgtaagagcagtgggagtttatataattagcgaattcttttctcagaattcagcggaaatgtatttctgttgttattatttacaaaattgtggcctcagaggagctgtcttttggaaaataagttttcattcatgcagttagttagacatgcacgatgtacttgaatcaataaactgtggaccagaaaagggctgcttaaatgaattcacgtgttctaattctctttcgaggctgttgatgacctcctggattcatacccccatgatctgtcttgctcttgcctctgttctttgataaagcacatcagactatgtgacacccatcttttcaagaacgacctaaaagcaatgacaacaggcaggagagaattaccactggcctgggcacagtgacagcagaaggcccacctgagcttggagagttggcgagataaggcaaaatcaaggtgcaacagtgggccatgttccaagggtgaatggatctgagagtccgctgatgttccttactgatcagaacagggaccttctaacgaaacagccagagttccttgaatcaggcagaagttctttagagacaggaagccagagctattgataatatccgaacgacagaggaaggaatttcttattagaaattctaaaataaaacaagtggggatttggttggatacccttagaagctacatttttctctcatccctaagatagatatctcaagtgtatatctgacacctcttggctttgacacggctctgcttctcaagtgaccatttgttttaagtctgttgtctagaattctttgtgggggctggacctctgaaaaagattctcactgcagaggctttaaatctgtgtttttttccactccctccgtcctgggatgtattcggtaggacatttcatttatatcaggatattggctgattcagctctctttcatcgttattattcaggcctccctccaccaccttgttctttattgcctaagtattgccctccccaattcttcatcgtaatagctctaaatttagtttgacccaaattaatttttgttccaacagatatattttaagacagagaagcctctctcaggagccagatgatctgaagatgatgctaatccccaaatacgaagttcctccagctaactctcctctgagctccctcttcttagctttgggattggggatggtctcatccttgccaggaatccctttgttgctcccagtgtctctgatgagcttctcctccctcccagagacaatgcaggggtggttttcagcagaatgtgccacctgcacttctgattgttctgagacccagcccagaggggtggagaaggcgcacaaaccctattccaataaactgcctgcagagaaccacagcctgctaatagtcgttgaggtctcagccccctaaggtctccaagctcatttgaccagcgcagctgcgacttcggctgtctgcctctggcaggtgccaatatcagcatcttgtcccactgccatggggagttaatttttgctccagggcagctgccaagcccagcaccggcatcaatagaaggttttctctgattttcttctcttcctctcaggctaggctttcttaccaatccccaattttcttctgtagggcgccaggagactggccagagatctttagactcttacttagtttgaacatctcttgctgctcacacccaggcttcttcagcagaaagcatgacccatagtaggtactcagaaactggttgaatgaaaagccttgacatttaagggctttattctgtcatacggtagcaagaactggcctattggcatcgtattcctggcattgagctgtattgaccctgaatgtgtcctcctgaggtttttgagggtgacctaggagaaagggtctgaaaaagcactgggatccaagtgactttaaatctgcccgtggcatttcctgctgagaggcgagaaactagcatctctcccaacaggctcacatccgccaggaaggacagagcccaaaacgggggtagactttgtgggaaattcgccagttagtccgctgagattttaatctgcctcaagcacaggatgctgacaagaaaggtagaccactcccccgatcccagacaaaccccaggggtgacaacttctccatcagtatcctgagaagcaacatcaaatgcttaccaagtcagcacgtttactgagtgagtactctgacggaataaaccagcatttggagctgaacttgagaacacagggccctctgacagcagcttagggaaacacccatcccttccagattggcagaatccttccatttcatgtccttcggagacgctgtattctctttacaaatcattcatgaaactgagactcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcacacacacacacacacacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaaacagtttcagaaacctgaatccagggccttatagttctcctcattatctatcttcttctcccttccctcgcccaagggagtgggggaaacacttttcactgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctgatttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttcttttttaaaaaaaaaaaaaaaaaaa

SEQ ID NO: 109 - protein, 460 aa, Homo sapiens
  ref <308>: DATABASE ACCESSION NUMBER: NCBI / NP_665736.1
  ref <309>: DATABASE ENTRY DATE: 2014-03-16
  ref <313>: RELEVANT RESIDUES IN SEQ ID NO: (1)..(460)
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 110 - DNA, 2898 bp, Homo sapiens
  ref <308>: DATABASE ACCESSION NUMBER: NCBI / NM_003360.3
  ref <309>: DATABASE ENTRY DATE: 2014-02-02
  ref <313>: RELEVANT RESIDUES IN SEQ ID NO: (1)..(2898)
gggttggttccaagtctttgctattgtgaatagtgccgcaataaacatacgtgtgcatgtgtctttatagcagcatgatttatagtcctttgggtatatacccagtaatgggatggctgggttctagatccctgaggaatcgccacattgacttgcacaatggttgaactagtttacagtcccaccaacagtgtaaaagtgttcctatttctccacatcctctccggcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgattttttttttagacaaagtattagatcagatatttttggggaaaaatgctttgtgattgcttgttttgaatggtgagcattgtattttgttttaagttgttttctggttgttattacagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccggagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatgtatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggtttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaagaaatggcacagttttttgtatttttttttttagttattttttgttgttgttgtttgtattgtttttcttttctgatagagtatggccacttctgggggaaaaacatgtaattaagtaaatgtatacattggttttcacgttttacttttgttttcccactaccaataatttt

SEQ ID NO: 111 - protein, 541 aa, Homo sapiens
  ref <308>: DATABASE ACCESSION NUMBER: NCBI / NP_003351.2
  ref <309>: DATABASE ENTRY DATE: 2014-02-02
  ref <313>: RELEVANT RESIDUES IN SEQ ID NO: (1)..(541)
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETMYHGVPVVGIPLFGDHYDTMTRVQAKGMGILLEWKTVTEKELYEALVKVINNPSYRQRAQKLSEIHKDQPGHPVNRTIYWIDYIIRHNGAHHLRAAVHQISFCQYFLLDIAFVLLLGAALLYFLLSWVTKFIYRKIKSLWSRNKHSTVNGHYHNGILNGKYKRNGHIKHEKKVK

SEQ ID NO: 112 - DNA, 6007 bp, Homo sapiens
  ref <308>: DATABASE ACCESSION NUMBER: NCBI / NM_001018111.2
  ref <309>: DATABASE ENTRY DATE: 2014-03-27
  ref <313>: RELEVANT RESIDUES IN SEQ ID NO: (1)..(6007)
agccgcgcagacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctactagagacagtgtttcaccatgtcagccaggctggtcttgaactcctgacctcgggtgatctgcccaccttggcctcccaaagtgctgggattacagcgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcagctctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttcaaaaaaaaaaaaaaaaaaaaaaaaa

SEQ ID NO: 113 - protein, 558 aa, Homo sapiens
  ref <308>: DATABASE ACCESSION NUMBER: NCBI / NP_001018121.1
  ref <309>: DATABASE ENTRY DATE: 2014-03-27
  ref <313>: RELEVANT RESIDUES IN SEQ ID NO: (1)..(558)
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLLETVFHHVSQAGLELLTSGDLPTLASQSAGITASSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 114 - DNA, 3024 bp, Homo sapiens
  ref <308>: DATABASE ACCESSION NUMBER: NCBI / NM_001005914.2
  ref <309>: DATABASE ENTRY DATE: 2014-06-14
  ref <313>: RELEVANT RESIDUES IN SEQ ID NO: (1)..(3024)
aaactttacggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaaccccagaaaaaaaaaaaaaaaaaaaa

SEQ ID NO: 115 - protein, 748 aa, Homo sapiens
  ref <308>: DATABASE ACCESSION NUMBER: NCBI / NP_001005914.1
  ref <309>: DATABASE ENTRY DATE: 2014-06-14
  ref <313>: RELEVANT RESIDUES IN SEQ ID NO: (1)..(748)
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 116 - DNA, 1338 bp, Homo sapiens
  ref <308>: DATABASE ACCESSION NUMBER: NCBI / NM_005386.2
  ref <309>: DATABASE ENTRY DATE: 2014-05-05
  ref <313>: RELEVANT RESIDUES IN SEQ ID NO: (1)..(1338)
taggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaaaaaaaaaaaaaaaaaaaaaaaaaaaaaaaaaaaa

SEQ ID NO: 117 - protein, 81 aa, Homo sapiens
  ref <308>: DATABASE ACCESSION NUMBER: NCBI / NP_005377.1
  ref <309>: DATABASE ENTRY DATE: 2014-05-05
  ref <313>: RELEVANT RESIDUES IN SEQ ID NO: (1)..(81)
MAAVAAASAELLIIGWYIFRVLLQVFLECCIYWVGFAFRNPPGTQPIARSEVFRYSLQKLAYTVSRTGRQVLGERRQRAPN

SEQ ID NO: 118 - DNA, 2699 bp, Homo sapiens
  ref <308>: DATABASE ACCESSION NUMBER: NCBI / NM_015232.1
  ref <309>: DATABASE ENTRY DATE: 2014-01-26
  ref <313>: RELEVANT RESIDUES IN SEQ ID NO: (1)..(2699)
aagcccctccccttctctgggccttgatttcccctcctgctcagtggggacgttcttggtcctccttcttgcccactctacccagtcgccgagtctggcgaagcagagctgtctgggggtcaccgcagcaggagggaccgagcttagatacgaaaaaagacttctacacggcaagagccacagaaaggacgctccagctggctcagcagaggggcatctctccctttcaagaacaaaaggtggcaggtacccgggggccctggggcagaacgaggtaaattctgcacggacttccacatctaagaccccagaaatctccagccggctccctccgaccgaatgagaccgtgctgcaccagttctgctgcccagccgccgacgcctgctccgacctggcctcccaaagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggt

SEQ ID NO: 119 - protein, 759 aa, Homo sapiens
  ref <308>: DATABASE ACCESSION NUMBER: NCBI / NP_056047.1
  ref <309>: DATABASE ENTRY DATE: 2014-01-26
  ref <313>: RELEVANT RESIDUES IN SEQ ID NO: (1)..(759)
MLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVLINASPARLTILPISRDTIKSYC

SEQ ID NO: 120 - DNA, 2735 bp, Homo sapiens
  ref <308>: DATABASE ACCESSION NUMBER: NCBI / NM_002427.3
  ref <309>: DATABASE ENTRY DATE: 2014-05-03
  ref <313>: RELEVANT RESIDUES IN SEQ ID NO: (1)..(2735)
acaacagtccccaggcatcaccattcaagatgcatccaggggtcctggctgccttcctcttcttgagctggactcattgtcgggccctgccccttcccagtggtggtgatgaagatgatttgtctgaggaagacctccagtttgcagagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaaggagcatggcgacttctacccatttgatgggccctctggcctgctggctcatgcttttcctcctgggccaaattatggaggagatgcccattttgatgatgatgaaacctggacaagtagttccaaaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaagaagataagtgcagctgttcactttgaggatacaggcaagactctcctgttctcaggaaaccaggtctggagatatgatgatactaaccatattatggataaagactatccgagactaatagaagaagacttcccaggaattggtgataaagtagatgctgtctatgagaaaaatggttatatctattttttcaacggacccatacagtttgaatacagcatctggagtaaccgtattgttcgcgtcatgccagcaaattccattttgtggtgttaagtgtctttttaaaaattgttatttaaatcctgaagagcatttggggtaatacttccagaagtgcggggtaggggaagaagagctatcaggagaaagcttggttctgtgaacaagcttcagtaagttatctttgaatatgtagtatctatatgactatgcgtggctggaaccacattgaagaatgttagagtaatgaaatggaggatctctaaagagcatctgattcttgttgctgtacaaaagcaatggttgatgatacttcccacaccacaaatgggacacatggtctgtcaatgagagcataatttaaaaatatatttataaggaaattttacaagggcataaagtaaatacatgcatataatgaataaatcattcttactaaaaagtataaaatagtatgaaaatggaaatttgggagagccatacataaaagaaataaaccaaaggaaaatgtctgtaataatagactgtaacttccaaataaataattttcattttgcactgaggatattcagatgtatgtgcccttcttcacacagacactaacgaaatatcaaagtcattaaagacaggagacaaaagagcagtggtaagaatagtagatgtggcctttgaattctgtttaattttcacttttggcaatgactcaaagtctgctctcatataagacaaatattcctttgcatattataaaggataaagaaggatgatgtctttttattaaaatatttcaggttcttcagaagtcacacattacaaagttaaaattgttatcaaaatagtctaaggccatggcatccctttttcataaattatttgattatttaagactaaaagttgcattttaaccctattttacctagctaattatttaattgtccagtttgtcttggatatataggctattttctaaagacttgtatagcatgaaataaaatatatcttataaagtggaagtatgtatattaaaaaagagacatccaaatttttttttaaagcagtctactagattgtgatcccttgagatatggaaggatgcctttttttctctgcatttaaaaaaatcccccagcacttcccacagtgcctattgatacttggggagggtgcttggcacttattgaatatatgatcggccatcaagggaagaactattgtgctcagagacactgttgataaaaactcaggcaaagaaaatgaaatgcatatttgcaaagtgtattaggaagtgtttatgttgtttataataaaaatatattttcaacagacaaaaaaaaaaaaaaaaaa

SEQ ID NO: 121 - protein, 471 aa, Homo sapiens
  ref <308>: DATABASE ACCESSION NUMBER: NCBI / NP_002418.1
  ref <309>: DATABASE ENTRY DATE: 2014-05-03
  ref <313>: RELEVANT RESIDUES IN SEQ ID NO: (1)..(471)
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 122 - DNA, 2812 bp, Homo sapiens
  ref <308>: DATABASE ACCESSION NUMBER: NCBI / NM_000787.3
  ref <309>: DATABASE ENTRY DATE: 2014-05-03
  ref <313>: RELEVANT RESIDUES IN SEQ ID NO: (1)..(2812)
accccagccatgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggaaaaaaaaaaaaaaaaaaaaaaaaaaaaaaaaaaaaaaaaaaaaaaaaaaaa

SEQ ID NO: 123 - protein, 617 aa, Homo sapiens
  ref <308>: DATABASE ACCESSION NUMBER: NCBI / NP_000778.3
  ref <309>: DATABASE ENTRY DATE: 2014-05-03
  ref <313>: RELEVANT RESIDUES IN SEQ ID NO: (1)..(617)
MPALSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 124 - DNA, 5507 bp, Homo sapiens
  ref <308>: DATABASE ACCESSION NUMBER: NCBI / NM_015130.2
  ref <309>: DATABASE ENTRY DATE: 2014-05-03
  ref <313>: RELEVANT RESIDUES IN SEQ ID NO: (1)..(5507)
gcggccgcgggctctcgcggggcggcgacgccgcggggaggatgctgcttgccgcgcccgcgtcctcaccgtcctcccgggccgcctgctggggctttgttgtggcccggacgccgcgggccaccccctgaagtcgcctgccgccgccgccgccgcacctagcggacgggcgggcgggcgcgcgtgtgcccaggagtgcgcgcctgtcgcggtggtgggtgcaggactggacccacgggcccattgtgcgcccgcccgcggcagccaggaccatgtgggtgaacccggaggaggtgttgctggccaacgcgctgtggatcaccgagagggccaacccatacttcatcctgcagcggaggaagggccacgccggcgatggaggcggcggcggcggactggcgggcctgctggtgggtacccttgatgttgtgttggactccagcgcccgggtcgctccttaccgaatcttgtaccagactccagactccctggtctactggaccatcgcctgtggtggttccaggaaagaaatcactgaacactgggaatggcttgagcaaaatctcttgcagacactctccatctttgaaaatgagaatgatatcaccacatttgtgagaggaaaaatacagggcatcattgcagaatacaacaaaatcaatgatgtaaaggaagatgatgacacggagaagtttaaagaagccattgtgaaatttcataggctgtttgggatgccagaggaagagaaactcgtcaactattactcttgcagctattggaaggggaaggtcccccgtcagggttggatgtacctcagcattaaccacctttgcttttattcttttcttatgggaagggaagcgaaactggtcatccggtgggtagacatcactcagcttgagaagaatgccaccctgcttctgcctgatgtgatcaaagtgagcacacggtccagtgagcatttcttctctgtattcctcaacatcaacgagaccttcaagttaatggagcagcttgccaacatagccatgaggcaactcttagacaatgagggatttgaacaagatcgatccctgcccaaactcaaaaggaaatctcctaaaaaagtgtctgctctaaaacgtgatcttgatgccagggcaaagagtgagagataccgtgcacttttccggctgcccaaagatgaaaaattagatggccacacagactgcactctctggactccatttaacaaaatgcacattttggggcagatgtttgtgtccacaaattacatctgttttaccagcaaggaggagaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccacgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactcagaaaaaaaaaaaaaaaaaaaaaa

SEQ ID NO: 125 - protein, 1266 aa, Homo sapiens
  ref <308>: DATABASE ACCESSION NUMBER: NCBI / NP_055945.2
  ref <309>: DATABASE ENTRY DATE: 2014-03-19
  ref <313>: RELEVANT RESIDUES IN SEQ ID NO: (1)..(1266)
MWVNPEEVLLANALWITERANPYFILQRRKGHAGDGGGGGGLAGLLVGTLDVVLDSSARVAPYRILYQTPDSLVYWTIACGGSRKEITEHWEWLEQNLLQTLSIFENENDITTFVRGKIQGIIAEYNKINDVKEDDDTEKFKEAIVKFHRLFGMPEEEKLVNYYSCSYWKGKVPRQGWMYLSINHLCFYSFLMGREAKLVIRWVDITQLEKNATLLLPDVIKVSTRSSEHFFSVFLNINETFKLMEQLANIAMRQLLDNEGFEQDRSLPKLKRKSPKKVSALKRDLDARAKSERYRALFRLPKDEKLDGHTDCTLWTPFNKMHILGQMFVSTNYICFTSKEENLCSLIIPLREVTIVEKADSSSVLPSPLSISTRNRMTFLFANLKDRDFLVQRISDFLQQTTSKIYSDKEFAGSYNSSDDEVYSRPSSLVSSSPQRSTSSDADGERQFNLNGNSVPTATQTLMTMYRRRSPEEFNPKLAKEFLKEQAWKIHFAEYGQGICMYRTEKTRELVLKGIPESMRGELWLLLSGAINEKATHPGYYEDLVEKSMGKYNLATEEIERDLHRSLPEHPAFQNEMGIAALRRVLTAYAFRNPNIGYCQAMNIVTSVLLLYAKEEEAFWLLVALCERMLPDYYNTRVVGALVDQGVFEELARDYVPQLYDCMQDLGVISTISLSWFLTLFLSVMPFESAVVVVDCFFYEGIKVIFQLALAVLDANVDKLLNCKDDGEAMTVLGRYLDSVTNKDSTLPPIPHLHSLLSDDVEPYPEVDIFRLIRTSYEKFGTIRADLIEQMRFKQRLKVIQTLEDTTKRNVVRTIVTETSFTIDELEELYALFKAEHLTSCYWGGSSNALDRHDPSLPYLEQYRIDFEQFKGMFALLFPWACGTHSDVLASRLFQLLDENGDSLINFREFVSGLSAACHGDLTEKLKLLYKMHVLPEPSSDQDEPDSAFEATQYFFEDITPECTHVVGLDSRSKQGADDGFVTVSLKPDKGKRANSQENRNYLRLWTPENKSKSKNAKDLPKLNQGQFIELCKTMYNMFSEDPNEQELYHATAAVTSLLLEIGEVGKLFVAQPAKEGGSGGSGPSCHQGIPGVLFPKKGPGQPYVVESVEPLPASLAPDSEEHSLGGQMEDIKLEDSSPRDNGACSSMLISDDDTKDDSSMSSYSVLSAGSHEEDKLHCEDIGEDTVLVRSGQGTAALPRSTSLDRDWAITFEQFLASLLTEPALVKYFDKPVCMMARITSAKNIRMMGKPLTSASDYEISAMSG

SEQ ID NO: 126 - DNA, 683 bp, Homo sapiens
  ref <308>: DATABASE ACCESSION NUMBER: NCBI / NM_014624.3
  ref <309>: DATABASE ENTRY DATE: 2014-03-02
  ref <313>: RELEVANT RESIDUES IN SEQ ID NO: (1)..(683)
ctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 127 - protein, 90 aa, Homo sapiens
  ref <308>: DATABASE ACCESSION NUMBER: NCBI / NP_055439.1
  ref <309>: DATABASE ENTRY DATE: 2014-03-02
  ref <313>: RELEVANT RESIDUES IN SEQ ID NO: (1)..(90)
MACPLDQAIGLLVAIFHKYSGREGDKHTLSKKELKELIQKELTIGSKLQDAEIARLMEDLDRNKDQEVNFQEYVTFLGALALIYNEALKG

SEQ ID NO: 128 - DNA, 3388 bp, Homo sapiens
  ref <308>: DATABASE ACCESSION NUMBER: NCBI / NM_178496.3
  ref <309>: DATABASE ENTRY DATE: 2014-02-02
  ref <313>: RELEVANT RESIDUES IN SEQ ID NO: (1)..(3388)
agttggctctacgaccgccgttgccgctgccagagagggccagggcagggcagggacgcgcagcatcggggcgggcgtggggccggagaaaagggtgtcggggccacacacgcaccctcgctgcagtccagctcctcccgaagctcgcacgcccagagcgcacggagcgggggactgcccgcccagacgcccgcccgccaacccgcccacgagccggggccaaagcctgggagcctgcgaggggaggaggcccaggggggcggggtggggggcgggggtgggtgccgcgctgccgcggagctgctactcggcgcgttttgcatgaagatggcggctcccaccgccaacaaggcagcctccctgggctgtaacaacaagcctgcgttcccggagctggatttcaggtcgggagctcgggtggaggaattgaacaaactcatccaagaatttacgaagcacgaccagcgggaatacgacgaccagagagcgctggagattcacacagccaaggatttcatcttttccatgctgggaatggtgcaaaagctggaccaaaagcttccagtggctaatgaatacctgttgctctctggaggtgtccgggaaggcgtggtggacctggacttagatgagcttaatgtctatgcccggggtactgactatgatatggactttaccctcttggtgccagccctcaagctgcatgaccgtaatcagcctgtgacactcgacatgcgccactcagccttgtgccactcttggctgagccttcggctctttgatgaggggacaatcagtaaatggaaagactgctgcaccattgtagatcacatcaatggtgccaccaactacttcttctcacctaccaaagtggctgactggttctatgactctatcagcattgtcctatcagaaatacagaagaaaccccagcgagggatgccaaaggtagaaaaggtggaaaaaaatgggaccatcatctccatcattctgggtgtagggagtagtcgcatgttgtatgatattgtccctgtggtatctttcaaaggttggcctgcagtggcccagagctggctcatggagaaccacttttgggatgggaagattactgaggaagaggtcatcagtgggttttacttggtgcctgcttgctcctacaagggtaagaaggacaatgaatggcggctgtcctttgccaggagcgaggtgcagttgaagaagtgcatctccagcagcctcatgcaggcctatcaggcctgcaaagccatcatcattaaactgctgtcccggcccaaggctattagcccctatcacctgcggagcatgatgctctgggcctgcgacagacttcctgccaactacttggctcaagaagactatgcagcccactttttgctgggcctcatcgatgacctgcaacactgtctggtcaacaagatgtgccccaattatttcatccctcagtgcaacatgctggaacatctgtctgaggagacagtcatgcttcacgcccggaagctgtcctctgtgcgctcagacccggcagagcacttgcgcaccgccattgagcatgtcaaggcagccaaccggctgacactggagctccagaggcgaggtagcaccaccagcatcccctctccacagtctgacggaggggaccccaaccagcctgatgaccgtttggcaaaaaaactgcagcagctagtgactgagaacccgggaaagtcaatctctgtctttatcaatcctgacgatgtcacaaggccccatttcagaattgatgacaaatttttctgagtgttagctgacttttttttttcctgattcttaaactctgataatgtgtcgtgtggtttgtgatgctatctttctgttttttacatatccagcctagattggatttgttaagaacaaattttaagtttcctggttctgcaggatggtgcaggctctgaaacagtatattactatttcatattctgcctctgatttcgttgtttactttttgtagttattgtcatgctctttagtttgttggagttttttttctttttaaggagatcttaagccatagatgaaaatgcccatgaatcctcttgcttttttctgtttcatacttggtgcaaatttgttcatgggtatggggaaacaaatctctttctgatgcttaacgattctatcctattatttttattattttgtttttgtcttttttcttatgagctttcaccactactgatatttgagaatcatatgaacctgggaactacttggcatgttagctggatttatttattttggccagtgaccagagtagtttccccccttttccaccaaacaatgtaaactttgaaagtgataatactacaaattgtgttttggagcaacttcattgaatgtaattgtcctcaaatcagagaacactgggtggtttgaagggtgtctttgacagttttccaagcagaattaaggtttccaaatgttaattttagcatatgtaattatttgaagccttatttaaatcctattaaagaacataccattataattattatttgcactaatctttgccattgtcagaattgcaaagtgtgtttcaatataaattaacaaccactctcgaaattctatcattttttcattttgcccatttctatcagtgaaatgattctttgcatttgcttagttctccttcagttgtggggtcctgctttgccctctttgatattcctggttcctgtcttactgagagaagttgttaaagctttatacatgttgaccccatctaaagctggggaaaatatacacttgatgaagtaggtgtctttgtatttatttcttttggggtcatagaggtaagcttttttgtaaaatctctactcttcctgagagttttgagaaaaactggcaggaagaacttataatccccaaatagaagataccacgtctgttcaaaagcaggtattgctatagagcagcacccaggaaatatctgtgggtggcagccttggtatagaggtgtcctgtcttcatgagtgaagttacttgcctgattaggtgctggaaggtattggctccctgttttggtgtggactcatggcaagctggtgtttaagaggtcaggaggcctgctgatctttcaaaggacacccatgatgtctactcatagaaagggcaagtaacgtgttcattttggtcttgaatgtccaaactcaagggttggattttggccaattgaaatcagacatatgcgatcttgggtttttgcatggaaattaatgtaatgcttataaatgaaaaatgaaaacatttcaaccatctaagtcaaacacaaaaataataaaaaaagaaacatactggccttgaaaaaaaaaaaaaaaaaaaaaaa

SEQ ID NO: 129 - protein, 491 aa, Homo sapiens
  ref <308>: DATABASE ACCESSION NUMBER: NCBI / NP_848591.2
  ref <309>: DATABASE ENTRY DATE: 2014-02-02
  ref <313>: RELEVANT RESIDUES IN SEQ ID NO: (1)..(491)
MKMAAPTANKAASLGCNNKPAFPELDFRSGARVEELNKLIQEFTKHDQREYDDQRALEIHTAKDFIFSMLGMVQKLDQKLPVANEYLLLSGGVREGVVDLDLDELNVYARGTDYDMDFTLLVPALKLHDRNQPVTLDMRHSALCHSWLSLRLFDEGTISKWKDCCTIVDHINGATNYFFSPTKVADWFYDSISIVLSEIQKKPQRGMPKVEKVEKNGTIISIILGVGSSRMLYDIVPVVSFKGWPAVAQSWLMENHFWDGKITEEEVISGFYLVPACSYKGKKDNEWRLSFARSEVQLKKCISSSLMQAYQACKAIIIKLLSRPKAISPYHLRSMMLWACDRLPANYLAQEDYAAHFLLGLIDDLQHCLVNKMCPNYFIPQCNMLEHLSEETVMLHARKLSSVRSDPAEHLRTAIEHVKAANRLTLELQRRGSTTSIPSPQSDGGDPNQPDDRLAKKLQQLVTENPGKSISVFINPDDVTRPHFRIDDKFF

SEQ ID NO: 130 - DNA, 6112 bp, Homo sapiens
  ref <308>: DATABASE ACCESSION NUMBER: NCBI / NM_004938.3
  ref <309>: DATABASE ENTRY DATE: 2014-05-05
  ref <313>: RELEVANT RESIDUES IN SEQ ID NO: (1)..(6112)
agagcgcgccagcgagcccggagcgcggagctgggaggagcagcgagcgccgcgcagaacccgcagcgccggcctggcagggcagctcggaggtgggtgggccgcgccgccagcccgcttgcagggtccccattggccgcctgccggccgccctccgcccaaaaggcggcaaggagccgagaggctgcttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcattaaaaaaaaaaaaaaa

SEQ ID NO: 131 - protein, 1430 aa, Homo sapiens
  ref <308>: DATABASE ACCESSION NUMBER: NCBI / NP_004929.2
  ref <309>: DATABASE ENTRY DATE: 2014-05-05
  ref <313>: RELEVANT RESIDUES IN SEQ ID NO: (1)..(1430)
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNQVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTSNGAPKDFLPSPLHALLREWTTYPESTVGTLMSKLRELGRRDAADFLLKASSVFKINLDGNGQEAYASSCNSGTSYNSISSVVSR

SEQ ID NO: 132 - DNA, 5802 bp, Homo sapiens
  ref <308>: DATABASE ACCESSION NUMBER: NCBI / NM_005458.7
  ref <309>: DATABASE ENTRY DATE: 2014-05-25
  ref <313>: RELEVANT RESIDUES IN SEQ ID NO: (1)..(5802)
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggcctaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaaaaaaaaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggattttttttttttttttcccactaactttgtttctgaccaaagtgaattggaggcactctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacacaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaataaaaggaaaaaacctgtcgtctttaaaaaaaaaaaaaaaa

SEQ ID NO: 133 - protein, 941 aa, Homo sapiens
  ref <308>: DATABASE ACCESSION NUMBER: NCBI / NP_005449.5
  ref <309>: DATABASE ENTRY DATE: 2014-05-25
  ref <313>: RELEVANT RESIDUES IN SEQ ID NO: (1)..(941)
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHAYLPSIGGVDASCVSPCVSPTASPRHRHVPPSFRVMVSGL

SEQ ID NO: 134 - DNA, 3318 bp, Homo sapiens
  ref <308>: DATABASE ACCESSION NUMBER: NCBI / NM_002069.5
  ref <309>: DATABASE ENTRY DATE: 2014-04-06
  ref <313>: RELEVANT RESIDUES IN SEQ ID NO: (1)..(3318)
ggaggccgagctcggctgggcttggcgaggctgcggcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacctccgtgaggacggcgagaaggcggcgcgcgaggtcaagctgctgctgctcggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaaaatgtttgatgtgggaggtcagagatctgagcggaagaagtggattcattgcttcgaaggagtgacggcgatcatcttctgtgtagcactgagtgactacgacctggttctagctgaagatgaagaaatgaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaataacataaatataccttgtactgaatgacagactattactacgtttgccagttttaaacagctttatttatgttcatgtcctgtaaatttttaagtacagtaattaatattaggaaacattacagcccttatctagattatatgtatacttgtattaataaaaatgttatttgtacaaacattgcacagactattttaataacatgatttgttctttaaattttatgtgttttattgaaatgttcttaagatgaatacacctgcctttggatcaactatttaaacattgtatgcattttgatttttcctactttaagaaaataaaataatttaattttacattagattccacgttagatttggtttgaaaaactaaaatttcagatttctgaggatatactgtcttagacttattgtacacacttagtttttattcacttgttttcactctgaattttaatatttggctgatatgaatgcattgcctcaaaggtgatgtcatcttaatttttattcactttaaataactacatttttgtttataactaagtttggagggatcctaagagcatttttgtgggtaaaaaaaaaacctgtggacataatgaattttgagacattgattggtgaggcttttatttcccttgaggagtctcttgtacctagcatacatgatagctccttgttgggaagataacaagaaggatctttgaatactctattgctgatataatgcaagatttaaatttatacatataactaatttcaaatgtaattatcacactatgttaaaattacttttttcccttagataattcaaatttctccacttgcttgagattatatcatttctttttcaattatactattatttctgagaatgaaatggacgattacacttagaaaatgagtaatagtgtttaataagtcagtgattatatgtgtgctcaaataagtgttatgtatcagctagatactgagctttgatagaataattttcttttgattattcatgatgtgtcatctctgaccttgtttcagcaaagtaaacagcactccccaccccaccctcctttttttactcatcttggaaaaggttagtctttcagtacacgttgctggtaagtagtttccaagttacgtgttgtcactgggttgaagtatatttgtgtgtgtgtgtgtgtgtgtgtgtgtgtgtgtaaccataaactatattcatatctgtttcatttggaggattttcttctttgtaatgtaaagaaattcaaagttatcaaagttccttaaatgtgttagtttagattctttatgtgcctttcatgaaagatatgttttcattaattttactggtggacctgtaatatccacattgtgaagctgtgtatgaaattcaactataatatgaataaatttgaatcatgagaattatgggttaaaaagccacaaagaagcacatattggtgaccatcattaatgaaatcctgaactttattctgtgtaattgtgttaataaatcctaataaatttaaatttttaaaattttacaaac

SEQ ID NO: 135 - protein, 354 aa, Homo sapiens
  ref <308>: DATABASE ACCESSION NUMBER: NCBI / NP_002060.4
  ref <309>: DATABASE ENTRY DATE: 2014-04-06
  ref <313>: RELEVANT RESIDUES IN SEQ ID NO: (1)..(354)
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 136 - DNA, 4197 bp, Homo sapiens
  ref <308>: DATABASE ACCESSION NUMBER: NCBI / NM_000623.3
  ref <309>: DATABASE ENTRY DATE: 2014-04-27
  ref <313>: RELEVANT RESIDUES IN SEQ ID NO: (1)..(4197)
atcactacccagcccttgaaagatgagctgttcccgccgccactccagctctggcttctgggctccgaggaggggtggggacggtggggacggtggggacatcaggctgccccgcagtaccagggagcgactgaagtgcccatgccgcttgctccggagaaggtgtggcctcactcacatcccactctgagtccaaatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccatctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaactggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcatagctctagcatttgttacaactcccgaaacccccgagtttggtccctggggtaccgccttgcacactcagaagcctttgggaaggggtgctattcatttctgctcaatctgttaacaggcttctggcatgtagatcagtggtctccaagcttttgtgattgtat

SEQ ID NO: 137 - protein, 391 aa, Homo sapiens
  ref <308>: DATABASE ACCESSION NUMBER: NCBI / NP_000614.1
  ref <309>: DATABASE ENTRY DATE: 2014-04-27
  ref <313>: RELEVANT RESIDUES IN SEQ ID NO: (1)..(391)
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 138 - DNA, 114 bp, Homo sapiens
gatcttcacagctgtgacatggttattccataatccatccccaagaggagcccacccaaagcaaaaaatcaaatctatccatccattataagatgatccatccatagactatat

SEQ ID NO: 139 - DNA, 23 bp, Homo sapiens
tccatccattataagatgatcca

SEQ ID NO: 140 - DNA, 23 bp, Homo sapiens
tccatccagcgtaagatgatcca

SEQ ID NO: 141 - DNA, 23 bp, Homo sapiens
tccatccattagcggatgatcca

SEQ ID NO: 142 - DNA, 23 bp, Homo sapiens
tccatccattataagcggatcca

SEQ ID NO: 143 - DNA, 23 bp, Homo sapiens
tccatccagcggtcgcagatcca

SEQ ID NO: 144 - DNA, 23 bp, Homo sapiens
tccatccaaaataagatgatcca

SEQ ID NO: 145 - DNA, 23 bp, Homo sapiens
tccatccattaaaagatgatcca

SEQ ID NO: 146 - DNA, 23 bp, Homo sapiens
tccatccaaaaaaaaaagatcca

SEQ ID NO: 147 - DNA, 23 bp, Homo sapiens
tccatccattttaagatgatcca

SEQ ID NO: 148 - DNA, 23 bp, Homo sapiens
tccatccattatttgatgatcca

SEQ ID NO: 149 - DNA, 22 bp, Homo sapiens
tccatccattttttttgatcca

SEQ ID NO: 150 - DNA, 25 bp, Homo sapiens
acagtgatgaagatgagttccaaat

SEQ ID NO: 151 - DNA, 25 bp, Homo sapiens
gataagaactctggcatcctgactc

SEQ ID NO: 152 - DNA, 27 bp, Homo sapiens
atgaaggaaacaaagtaaaaataagca

SEQ ID NO: 153 - DNA, 25 bp, Homo sapiens
gtcatcatggacaactttgagtacc

SEQ ID NO: 154 - DNA, 23 bp, Homo sapiens
agtctcgggtgaggtactcaaag

SEQ ID NO: 155 - DNA, 21 bp, Homo sapiens
gacaacaccgtccacttcaat

SEQ ID NO: 156 - DNA, 21 bp, Homo sapiens
aatcttgatgtccagggctgt

SEQ ID NO: 157 - DNA, 20 bp, Homo sapiens
ccgacaaacagcagatggac

SEQ ID NO: 158 - DNA, 22 bp, Homo sapiens
ctagcgtcttctgggacagatt

SEQ ID NO: 159 - DNA, 20 bp, Homo sapiens
agagcaaggccaagaagctg

SEQ ID NO: 160 - DNA, 20 bp, Homo sapiens
cagcttcttggccttgctct

SEQ ID NO: 161 - DNA, 20 bp, Homo sapiens
ggacacccctcatgttccag

SEQ ID NO: 162 - DNA, 20 bp, Homo sapiens
gaaagcggcctcaaggagag

SEQ ID NO: 163 - DNA, 21 bp, Homo sapiens
cgtcttctggaacatctcctg

SEQ ID NO: 164 - DNA, 21 bp, Homo sapiens
agtagccatctctgcccatct

SEQ ID NO: 165 - protein, 7 aa, Homo sapiens
MIMEYYR

SEQ ID NO: 166 - protein, 5 aa, Homo sapiens
MIMEY

SEQ ID NO: 167 - DNA, 19 bp, Homo sapiens
atctacgcagccccatggg

SEQ ID NO: 168 - DNA, 21 bp, Homo sapiens
atctacgcagccatccatggg

SEQ ID NO: 169 - DNA, 20 bp, Homo sapiens
atctacgcagccaccatggg

SEQ ID NO: 170 - DNA, 54 bp, Homo sapiens
gagcccaccccaaagcaaaaaatcaaatctatccatccattataagatgatcca

SEQ ID NO: 171 - DNA, 51 bp, Homo sapiens
atatgacacccagcaagggatatcttgtttatagacttaaaaacaccaaac

SEQ ID NO: 172 - DNA, 47 bp, Homo sapiens
agaccatcatggccaacatggtgaaaccccgtctctactaaaaatac

SEQ ID NO: 173 - DNA, 49 bp, Homo sapiens
gagaccagcctgaccaacatggagaaactccgtctctactaaaaataca

SEQ ID NO: 174 - DNA, 50 bp, Homo sapiens
  misc_feature (14)..(14): n is a, c, g, or t
  misc_feature (21)..(23): n is a, c, g, or t
  misc_feature (31)..(31): n is a, c, g, or t
  misc_feature (34)..(34): n is a, c, g, or t
  misc_feature (46)..(46): n is a, c, g, or t
gagaccaccctgancaacatnnngaaactcngtntctactaaaaanacaa

SEQ ID NO: 175 - DNA, 23 bp, Homo sapiens
tccatccagcggtcgatgatcca

SEQ ID NO: 176 - DNA, 23 bp, Homo sapiens
tccatccattagtcgatgatcca

SEQ ID NO: 177 - DNA, 23 bp, Homo sapiens
tccatccagcgtaagatgatcca

SEQ ID NO: 178 - DNA, 23 bp, Homo sapiens
tccatccattataagatgatcca

What is claimed is:

1. A method of treating a subject with spinocerebellar ataxia Type 6 (SCA6) or a predisposition to SCA6, comprising the step of administering to the subject an IRES inhibitor in an amount effective for treating the SCA6 in the subject or for delaying development of SCA6 in the subject, wherein the IRES inhibitor is an antisense molecule that is about 15 to about 30 nucleotides in length and binds to a portion of the sequence of SEQ ID NO: 5 and suppresses the expression of the nucleic acid encoding the α1ACT protein without affecting the expression of the nucleic acid of the α1A protein.

2. The method of claim 1, wherein the IRES inhibitor binds within 200 bp upstream of the start codon of the coding sequence encoding α1ACT of the α1A mRNA, or to the IRES of the α1A mRNA.

3. The method of claim 1, wherein the IRES inhibitor binds to at least a portion of the sequence of SEQ ID NO: 6 or SEQ ID NO: 7.

4. The method of claim 1, wherein the IRES inhibitor is an antisense molecule comprising (a) at least 15 contiguous nucleobases of SEQ ID NO: 9, SEQ ID NO: 10, or SEQ ID NO: 11, (b) at least 25 contiguous nucleobases of SEQ ID NO: 9, SEQ ID NO: 10, or SEQ ID NO: 11, (c) at least 15 or at least 25 contiguous nucleobases of a sequence that (i) differs from SEQ ID NO: 9 by not more than 3 nucleobases or (ii) is at least 90% identical to the sequence set forth in SEQ ID NO: 9, (d) at least 15 or at least 25 contiguous nucleobases of a sequence that (i) differs from SEQ ID NO: 10 by not more than 3 nucleobases or (ii) is at least 90% identical to the sequence set forth in SEQ ID NO: 10, (e) at least 15 or at least 25 contiguous nucleobases of a sequence that (i) differs from SEQ ID NO: 11 by not more than 3 nucleobases or (ii) is at least 90% identical to the sequence set forth in SEQ ID NO: 11.

5. The method of claim 1, wherein the IRES inhibitor is an antisense molecule which is an antisense oligonucleotide comprising nucleotides, wherein each nucleotide comprises a nucleobase and either deoxyribose or ribose.

6. The method of claim 1, wherein the antisense molecule is an antisense nucleic acid analog, optionally comprising a 6-membered morpholine ring and/or non-ionic phosphorodiamidate intersubunit linkages and/or a combination of nucleobases comprising at least adenine, cytosine, guanine, and either thymine or uracil.

7. The method of claim 1, wherein the antisense molecule binds to at least 15 contiguous nucleotides of the sequence of SEQ ID NO: 5.

8. A method of treating a subject with spinocerebellar ataxia Type 6 (SCA6), comprising the step of administering to the subject an antisense molecule that is about 15 to about 30 nucleotides in length and binds to at least 15 contiguous nucleotides of the sequence of SEQ ID NO: 5 or 6.

9. The method of claim 8, wherein the antisense molecule comprises at least 15 contiguous nucleobases of SEQ ID NO: 9.

10. The method of claim 8, wherein the antisense molecule comprises at least 15 contiguous nucleobases of SEQ ID NO: 10.

11. The method of claim 8, wherein the antisense molecule comprises at least 15 contiguous nucleobases of SEQ ID NO: 11.

12. The method of claim 8, wherein the antisense molecule comprises the sequence of SEQ ID NO: 8.

13. The method of claim 8, wherein the antisense molecule comprises (i) a 6-membered morpholine ring, (ii) a non-ionic phosphorodiamidate intersubunit linkage, or (iii) a combination thereof.

* * * * *

UNITED STATES PATENT AND TRADEMARK OFFICE
CERTIFICATE OF CORRECTION

PATENT NO. : 10,017,765 B2
APPLICATION NO. : 15/024492
DATED : July 10, 2018
INVENTOR(S) : Christopher M. Gomez et al.

Page 1 of 1

It is certified that error appears in the above-identified patent and that said Letters Patent is hereby corrected as shown below:

In the Specification

Column 1, Line 18:
--This invention was made with government support under Grant No. NS-062771 awarded by the National Institute of Neurological Disorders and Stroke. The government has certain rights in the invention.--

Should read:
--This invention was made with government support under Grant Number NS062771, awarded by the National Institutes of Health. The government has certain rights in the invention.--

Signed and Sealed this
Twenty-first Day of July, 2020

Andrei Iancu
*Director of the United States Patent and Trademark Office*